US012252702B2

(12) United States Patent
Deng et al.

(10) Patent No.: US 12,252,702 B2
(45) Date of Patent: Mar. 18, 2025

(54) RECOMBINANT POXVIRUSES FOR CANCER IMMUNOTHERAPY

(71) Applicant: Memorial Sloan Kettering Cancer Center, New York, NY (US)

(72) Inventors: Liang Deng, New York, NY (US); Jedd Wolchok, New York, NY (US); Stewart Shuman, New York, NY (US); Taha Merghoub, New York, NY (US); Ning Yang, New York, NY (US); Yi Wang, New York, NY (US); Gregory Mazo, New York, NY (US); Peihong Dai, New York, NY (US); Weiyi Wang, New York, NY (US)

(73) Assignee: MEMORIAL SLOAN KETTERING CANCER CENTER, New York, NY (US)

(*) Notice: Subject to any disclaimer, the term of this patent is extended or adjusted under 35 U.S.C. 154(b) by 173 days.

(21) Appl. No.: 17/275,974

(22) PCT Filed: Sep. 16, 2019

(86) PCT No.: PCT/US2019/051343

§ 371 (c)(1),
(2) Date: Mar. 12, 2021

(87) PCT Pub. No.: WO2020/056424

PCT Pub. Date: Mar. 19, 2020

(65) Prior Publication Data

US 2022/0056475 A1 Feb. 24, 2022

Related U.S. Application Data

(60) Provisional application No. 62/828,975, filed on Apr. 3, 2019, provisional application No. 62/767,485, filed on Nov. 14, 2018, provisional application No. 62/731,876, filed on Sep. 15, 2018.

(51) Int. Cl.

| | |
|---|---|
| ***C12N 15/86*** | (2006.01) |
| ***A61K 9/00*** | (2006.01) |

(Continued)

(52) U.S. Cl.

CPC ............ *C12N 15/86* (2013.01); *A61K 9/0019* (2013.01); *A61K 31/137* (2013.01); *A61K 39/39* (2013.01); *A61K 39/39558* (2013.01); *A61K 45/06* (2013.01); *A61P 35/00* (2018.01); *A61P 37/04* (2018.01); *C07K 14/54* (2013.01); *C07K 14/5434* (2013.01); *C07K 14/5443* (2013.01); *C07K 14/55* (2013.01); *C07K 14/70575* (2013.01); *C07K 14/71* (2013.01); *C07K 16/2818* (2013.01); *C12N 7/00* (2013.01); *A61K 2039/5256* (2013.01); *A61K 2039/54* (2013.01); *A61K 2039/545* (2013.01); *A61K 2039/55516* (2013.01); *A61K 2039/585* (2013.01); *C12N 2710/24134* (2013.01); *C12N 2710/24143* (2013.01)

(58) Field of Classification Search

CPC ..... A61P 37/04; A61K 9/0019; A61K 31/137; A61K 39/39

See application file for complete search history.

(56) References Cited

U.S. PATENT DOCUMENTS

| | | | |
|---|---|---|---|
| 5,494,807 | A | 2/1996 | Paoletti et al. |
| 5,762,938 | A | 6/1998 | Paoletti et al. |

(Continued)

FOREIGN PATENT DOCUMENTS

| | | | |
|---|---|---|---|
| CA | 2435967 | A1 | 1/2005 |
| CA | 2436196 | A1 | 1/2005 |

(Continued)

OTHER PUBLICATIONS

Yang et al., Vaccinia E5 is a major inhibitor of the DNA sensor cGAS, Nature Communications, (2023)14:2898 (Year: 2023).*

(Continued)

*Primary Examiner* — Peter J Reddig
*Assistant Examiner* — Cheng Lu
(74) *Attorney, Agent, or Firm* — ArentFox Schiff LLP; Daniel W. Clarke

(57) ABSTRACT

Disclosed herein are methods and compositions related to the treatment, prevention, and/or amelioration of cancer in a subject in need thereof. In particular aspects, the present technology relates to the use of genetically engineered or recombinant poxviruses, including a modified vaccinia Ankara (MVA) virus comprising a deletion of E3L (MVAΔE3L) engineered to express OX40L (MVAΔE3L-OX40L), an MVA virus comprising a deletion of C7L (MVAΔC7L) engineered to express OX40L (MVAΔC7L-OX40L), a MVAΔC7L engineered to express OX40L and human Fms-like tyrosine kinase 3 ligand (hFlt3L) (MVAΔC7L-hFlt3L-OX40L), an MVA comprising a deletion of E5R (MVAΔE5R), a vaccinia virus comprising a deletion of C7L (VACVΔC7L) engineered to express OX40L (VACVΔC7L-OX40L), a VACVΔC7L engineered to express both OX40L and hFlt3L (VACVΔC7L-hFlt3L-OX40L), a VACV comprising a deletion of E5R (VACVΔE5R), a myxoma virus (MYXV) comprising a deletion of M31R (MYXVΔM31R), or combinations thereof, alone or in combination with other agents, as an oncolytic and immunotherapeutic composition.

24 Claims, 581 Drawing Sheets

Specification includes a Sequence Listing.

(51) Int. Cl.

| | |
|---|---|
| *A61K 31/137* | (2006.01) |
| *A61K 39/00* | (2006.01) |
| *A61K 39/39* | (2006.01) |
| *A61K 39/395* | (2006.01) |
| *A61K 45/06* | (2006.01) |
| *A61P 35/00* | (2006.01) |
| *A61P 37/04* | (2006.01) |
| *C07K 14/54* | (2006.01) |
| *C07K 14/55* | (2006.01) |
| *C07K 14/705* | (2006.01) |
| *C07K 14/71* | (2006.01) |
| *C07K 16/28* | (2006.01) |
| *C12N 7/00* | (2006.01) |

(56) References Cited

U.S. PATENT DOCUMENTS

| | | | |
|---|---|---|---|
| 5,766,882 | A | 6/1998 | Falkner et al. |
| 6,004,777 | A | 12/1999 | Tartaglia et al. |
| 6,265,189 | B1 | 7/2001 | Paoletti |
| 6,372,455 | B1 | 4/2002 | Jacobs et al. |
| 6,475,999 | B1 | 11/2002 | Mastrangelo et al. |
| 6,548,068 | B1 | 4/2003 | Schlom et al. |
| 6,750,043 | B2 | 6/2004 | Jacobs et al. |
| 6,761,893 | B2 | 7/2004 | Chaplin et al. |
| 6,846,652 | B2 | 1/2005 | Jacobs et al. |
| 6,942,855 | B2 | 9/2005 | Jacobs et al. |
| 7,001,718 | B2 | 2/2006 | Jacobs et al. |
| 7,049,145 | B2 | 5/2006 | Erfle et al. |
| 7,208,313 | B2 | 4/2007 | McCart et al. |
| 7,252,817 | B2 | 8/2007 | Coffey et al. |
| 7,256,037 | B2 | 8/2007 | Ellenhorn et al. |
| 7,306,902 | B2 | 12/2007 | Thompson et al. |
| 7,431,929 | B2 | 10/2008 | Jacobs et al. |
| 7,550,147 | B2 | 6/2009 | Howley et al. |
| 7,588,767 | B2 | 9/2009 | Szalay et al. |
| 7,807,146 | B2 | 10/2010 | Delcayre et al. |
| 8,052,968 | B2 | 11/2011 | Chen et al. |
| 8,105,578 | B2 | 1/2012 | Roberts et al. |
| 8,377,688 | B2 | 2/2013 | Delcayre et al. |
| 8,506,947 | B2 | 8/2013 | McCart et al. |
| 8,679,509 | B2 | 3/2014 | Evans et al. |
| 8,747,837 | B2 | 6/2014 | Kirn et al. |
| 8,778,328 | B2 | 7/2014 | Erbs et al. |
| 8,852,927 | B2 | 10/2014 | Szalay et al. |
| 8,859,256 | B2 | 10/2014 | Szalay et al. |
| 8,865,153 | B2 | 10/2014 | Szalay et al. |
| 8,871,219 | B2 | 10/2014 | Heeney et al. |
| 9,101,658 | B2 | 8/2015 | Contag et al. |
| 9,175,057 | B2 | 11/2015 | Schlom et al. |
| 9,180,150 | B2 | 11/2015 | Erbs et al. |
| 9,234,197 | B2 | 1/2016 | Chaput et al. |
| 9,273,327 | B2 | 3/2016 | Cottingham |
| 9,670,506 | B2 | 6/2017 | Pantaleo et al. |
| 9,879,281 | B2 | 1/2018 | Son et al. |
| 9,919,062 | B2 | 3/2018 | Kirn |
| 10,548,930 | B2 | 2/2020 | Deng et al. |
| 10,639,366 | B2 | 5/2020 | Deng et al. |
| 10,736,962 | B2 | 8/2020 | Deng et al. |
| 11,253,560 | B2 | 2/2022 | Deng et al. |
| 11,285,209 | B2 | 3/2022 | Deng et al. |
| 2002/0061298 | A1 | 5/2002 | Coffey et al. |
| 2002/0155529 | A1 | 10/2002 | Jacobs et al. |
| 2003/0113919 | A1 | 6/2003 | Emtage et al. |
| 2004/0091995 | A1 | 5/2004 | Schlom et al. |
| 2004/0208850 | A1 | 10/2004 | Ellenhorn et al. |
| 2005/0028226 | A1 | 2/2005 | Erfle et al. |
| 2005/0287162 | A1 | 12/2005 | Baier et al. |
| 2006/0088909 | A1 | 4/2006 | Compans et al. |
| 2006/0099181 | A1 | 5/2006 | Jacobs et al. |
| 2006/0216312 | A1 | 9/2006 | Jacobs |
| 2007/0036758 | A1 | 2/2007 | Jacobs et al. |
| 2007/0178065 | A1 | 8/2007 | Lattime et al. |
| 2007/0275010 | A1 | 11/2007 | Feinberg et al. |
| 2008/0075694 | A1 | 3/2008 | Drexler et al. |
| 2008/0181870 | A1 | 7/2008 | Lowenstein et al. |
| 2009/0162288 | A1 | 6/2009 | Chen et al. |
| 2010/0247622 | A1 | 9/2010 | Coffey et al. |
| 2010/0316609 | A1 | 12/2010 | Dewhurst et al. |
| 2011/0064650 | A1 | 3/2011 | Szalay |
| 2011/0142874 | A1 | 6/2011 | Jacobs et al. |
| 2011/0206640 | A1 | 8/2011 | Bell et al. |
| 2012/0308484 | A1 | 12/2012 | Szalay et al. |
| 2012/0328649 | A1 | 12/2012 | Falkner et al. |
| 2013/0195912 | A1 | 8/2013 | Cottingham |
| 2013/0243813 | A1 | 9/2013 | Howley et al. |
| 2013/0295675 | A1 | 11/2013 | Jacobs et al. |
| 2014/0086976 | A1 | 3/2014 | Szalay et al. |
| 2014/0087362 | A1 | 3/2014 | Szalay et al. |
| 2014/0193859 | A1 | 7/2014 | Jacobs et al. |
| 2014/0271549 | A1 | 9/2014 | Szalay |
| 2014/0377870 | A1 | 12/2014 | Jacobs et al. |
| 2015/0037355 | A1 | 2/2015 | Kirn et al. |
| 2015/0202272 | A1 | 7/2015 | Lauterbach et al. |
| 2015/0240246 | A1 | 8/2015 | Jacobs et al. |
| 2015/0250837 | A1 | 9/2015 | Nolin et al. |
| 2015/0250869 | A1 | 9/2015 | Sene et al. |
| 2015/0283220 | A1 | 10/2015 | Mandl et al. |
| 2016/0008479 | A1 | 1/2016 | Antony |
| 2016/0130564 | A1 | 5/2016 | Marais et al. |
| 2016/0185875 | A1 | 6/2016 | Cheng et al. |
| 2016/0235793 | A1 | 8/2016 | Thorne |
| 2016/0271239 | A1 | 9/2016 | Foy et al. |
| 2016/0339090 | A1 | 11/2016 | Hacohen et al. |
| 2017/0020938 | A1 | 1/2017 | Wang et al. |
| 2017/0021009 | A1 | 1/2017 | Jacobs et al. |
| 2017/0106065 | A1 | 4/2017 | Foy et al. |
| 2017/0143780 | A1 | 5/2017 | Zitvogel et al. |
| 2017/0157188 | A1 | 6/2017 | Silvestre et al. |
| 2017/0246280 | A1 | 8/2017 | Pantaleo et al. |
| 2017/0266270 | A1 | 9/2017 | Foy et al. |
| 2017/0340687 | A1 | 11/2017 | Nakao et al. |
| 2022/0056475 | A1 | 2/2022 | Deng et al. |
| 2023/0057304 | A1 | 2/2023 | Deng et al. |

FOREIGN PATENT DOCUMENTS

| | | | |
|---|---|---|---|
| CN | 1842602 | A | 10/2006 |
| CN | 105039269 | A | 11/2015 |
| CN | 106456747 | A | 2/2017 |
| CN | 107735103 | A | 2/2018 |
| CN | 109152827 | A | 1/2019 |
| CN | 105377297 | A | 9/2019 |
| DE | 10144664.9 | A1 | 6/2005 |
| EP | 2 771 465 | A1 | 5/2013 |
| EP | 2 136 633 | B1 | 10/2015 |
| EP | 3 142 690 | A2 | 4/2017 |
| EP | 3 850 103 | A1 | 7/2021 |
| JP | 2005-502360 | A | 1/2005 |
| JP | 2006-512097 | A | 4/2006 |
| JP | 2010-521497 | A | 6/2010 |
| JP | 5690214 | B2 | 3/2015 |
| WO | WO-03/023040 | A2 | 3/2003 |
| WO | WO-2003/088994 | | 10/2003 |
| WO | WO-2004/024756 | A2 | 3/2004 |
| WO | WO-2004/058801 | A2 | 7/2004 |
| WO | WO-2004/003987 | A1 | 8/2004 |
| WO | WO-2006/120474 | A2 | 11/2006 |
| WO | WO-2007/119895 | A1 | 10/2007 |
| WO | WO-2008/045346 | A2 | 4/2008 |
| WO | WO-2008/113078 | A1 | 9/2008 |
| WO | WO-2009/152179 | A1 | 12/2009 |
| WO | WO-2011/156470 | A1 | 12/2011 |
| WO | WO-2012/009644 | A2 | 1/2012 |
| WO | WO-2013/038066 | A1 | 3/2013 |
| WO | WO-2014/036412 | A2 | 3/2014 |
| WO | WO-2014/081976 | A1 | 5/2014 |
| WO | WO-2015/066715 | A1 | 5/2015 |

(56) References Cited

FOREIGN PATENT DOCUMENTS

| | | | |
|---|---|---|---|
| WO | WO-2015/069571 | A1 | 5/2015 |
| WO | WO-2015/084897 | A2 | 6/2015 |
| WO | WO-2015/138741 | A1 | 9/2015 |
| WO | WO-2016/008976 | A1 | 1/2016 |
| WO | WO-2016/046357 | A1 | 3/2016 |
| WO | WO-2016/128542 | A1 | 8/2016 |
| WO | WO-2016/144564 | A1 | 9/2016 |
| WO | WO-2016/144564 | A2 | 9/2016 |
| WO | WO-2016/168862 | A1 | 10/2016 |
| WO | WO-2016/205429 | A1 | 12/2016 |
| WO | WO-2017/024000 | A1 | 2/2017 |
| WO | WO-2017/037523 | A1 | 3/2017 |
| WO | WO-2017/043815 | A1 | 3/2017 |
| WO | WO-2017/044780 | A1 | 3/2017 |
| WO | WO-2017/075570 | A1 | 5/2017 |
| WO | WO-2017/103291 | A1 | 6/2017 |
| WO | WO-2017/129765 | A1 | 8/2017 |
| WO | WO-2017/147553 | A2 | 8/2017 |
| WO | WO-2017/147554 | A1 | 8/2017 |
| WO | WO-2017/147554 | A2 | 8/2017 |
| WO | WO-2017/156349 | A1 | 9/2017 |
| WO | WO-2017/205674 | A1 | 11/2017 |
| WO | WO-2018/015448 | A1 | 1/2018 |
| WO | WO-2018/016917 | A1 | 1/2018 |
| WO | WO-2018/017747 | A2 | 1/2018 |
| WO | WO-2018/031694 | A1 | 1/2018 |
| WO | WO-2018/049248 | A1 | 3/2018 |
| WO | WO-2018/057755 | A1 | 3/2018 |
| WO | WO-2018/058258 | A1 | 4/2018 |

OTHER PUBLICATIONS

Gura, T., Systems for Identifying New Drugs Are Often Faulty, Science, 1997, 278:1041-1042 (Year: 1997).*

Kaiser, J., First pass at cancer genoome reveals complex landscape, Science, 2006, 313:1370 (Year: 2006).*

Gerdes et al. Emerging understanding of multiscale tumor heterogeneity, Front. Oncol. Dec. 18, 2014 doi: 10.3389/fonc.2014.00366, pp. 1-12 (Year: 2014).*

Liu Z, Zhou H, Wang W, Fu YX, Zhu M. A novel dendritic cell targeting HPV16 E7 synthetic vaccine in combination with PD-L 1 blockade elicits therapeutic antitumor immunity in mice. Oncoimmunology. Mar. 10, 2016;5(6):e1147641. doi: 10.1080/2162402X .2016.1147641. PMID: 27471615; PMCID: PMC4938372. (Year: 2016).

Terawaki S, Chikuma S, Shibayama S, Hayashi T, Yoshida T, Okazaki T, Honjo T. IFN-a directly promotes programmed cell death-1 transcription and limits the duration of T cell-mediated immunity. J Immunol. Mar. 1, 2011; 186(5):2772-9. (Year: 2011).

Yang, et al., "Vaccinia ES is a major inhibitor of the DNA sensor cGAS." BioRxiv, Oct. 26, 2021, 45 pages.

Yang, et al., "Intratumoral delivery of engineered recombinant modified vaccinia virus Ankara expressing Flt3L and OX40L generates potent antitumor immunity through activating the cGAS/STING pathway and depleting tumor-infiltrating regulatory T cells." BioRxiv, Nov. 1, 2021, 53 pages.

Yang, et al., "Vaccinia virus E5 is a dominant inhibitor of the cytosolic DNA sensor cGAS." J. of Immunol., May 1, 2019, vol. 202, No. 1 Suppl., p. 197.8.

Benci et al., "Tumor Interferon Signaling Regulates a Multigenic Resistance Program to Immune Checkpoint Blockade." Cell. Dec. 1, 2016; 167(6): 1540-1554.e12.

Kirkwood et al., "High-Dose Interferon Alfa-2b Significantly Prolongs Relapse-Free and Overall Survival Compared With the GM2-KLH/QS-21 Vaccine in Patients With Resected Stage IIB-III Melanoma: Results of Intergroup Trial E1694/S9512/C509801." Journal of Clinical Oncology 19:2370-2380, 2001, American Society of Clinical Oncology.

Medrano et al., "Immunomodulatory and antitumor effects of type I interferons and their application in cancer therapy." Oncotarget, 2017, vol. 8, (No. 41), pp. 71249-71284.

Melief CJ. Cancer immunotherapy by dendritic cells. Immunity. Sep. 19, 2008;29(3):372-83. doi: 10.1016/j.immuni.2008.08.004. PMID: 18799145 (Year: 2008).

Foy et al., "Poxvirus immunotherapies in combination with immune checkpoint inhibitors synergize to eliminate tumors in a mouse tumor model." Journal for ImmunoTherapy of Cancer 2013, 1(Suppl 1):p. 72.

Wong et al. Oncolytic Viruses for Cancer Therapy: Overcoming the Obstacles. Viruses, 2010, 2: 78-106.

Alharbi, et al., "ChAdOx1 and MVA based vaccine candidates against MERS-COV elicit neutralising antibodies and cellular immune responses in mice," Vaccine, vol. 35, pp. 3780-3788 (Jun. 27, 2017).

Angell et al., "From the immune contexture to the Immunoscore: the role of prognostic and predictive immune markers in cancer," Curr. Opin. Immunol., 25, pp. 261-267 (2013).

Antoine et al., "The complete genomic sequence of the modified vaccinia Ankara strain: comparison with other orthopoxviruses", Virology, 244, pp. 365-396 (1998).

Arsenio et al., "Antagonizing activity of vaccinia virus E3L against human interferons in Huh7 cells," Journal of Virology, vol. 377, No. 1, p. 124-132 (Jul. 20, 2008).

Backes et al., "Viral host-range factor C7 or K1 is essential for modified vaccinia virus Ankara late gene expression in human and murine cells, irrespective of their capacity to inhibit protein kinase R-mediated phosphorylation of eukaryotic translation initiation factor 2a," J. of General Virology, vol. 91, pp. 470-482 (Feb. 1, 2010).

Barber, "Innate immune DNA sensing pathways: STING, AIMII and the regulation of interferon production and inflammatory responses", Curr. Opin. Immunol., 23, pp. 10-20 (2011).

Bisht et al., "Severe acute respiratory syndrome coronavirus spike protein expressed by attenuated vaccinia virus protectively immunizes mice," PNAS, vol. 101, pp. 6641-6646 (Apr. 27, 2004).

Bommareddy et al., "MEK inhibition enhances oncolytic virus immunotherapy through increased tumor cell killing and T cell activation," Science Translational Medicine, vol. 10, Issue 471 (Dec. 12, 2018).

Brandler et al., "Preclinical studies of a modified vaccinia virus Ankara-based HIV candidate vaccine: antigen presentation and antiviral effect", J. Virol., vol. 84, No. 10, pp. 5314-5328 (2010).

Brandt et al., "The N-terminal domain of the vaccinia virus E3L-protein is required for neurovirulence" Virology, vol. 333, No. 2, pp. 263-270 (Mar. 15, 2005).

Breitbach et al., "Targeted and armed oncolytic poxviruses for cancer: the lead example of JX-594," Current Pharmaceutical Biotechnology, 13, pp. 1768-1772 (2012).

Brinkman et al., "Fingolimod (FTY720): discovery and development of an oral drug to treat multiple sclerosis," Nature Reviews | Drug Discovery, vol. 9, pp. 883-897 (Nov. 2010).

Caisova et al., "Innate immunity based cancer immunotherapy: B16-F10 murine melanoma model," BMC Cancer, 16:940, 11 pages (2016).

Cao et al., "Innate immune response of human plasmacytoid dendritic cells to poxvirus infection is subverted by vaccinia E3 via its Z-DNA/RNA binding domain," PLOS One, vol. 7, No. 5, p. e36823 (May 14, 2012).

Carina Riediger et al:Fms-like tyrosine kinase 3 receptor ligand (Flt3L)-based vaccination administered with an adenoviral vector prevents tumor growth of colorectal cancer in a BALB/c mouse model 11 , Journal of Cancer Research and Clinical Oncology., vol. 139, No. 12, Oct. 10, 2013 (Oct. 10, 2013), pp. 2097-2110, XP055672630, DE ISSN: 0171-5216, DOI: 10.1007/s00432-013-1532-z * Figures 6, 8 *.

Castle et al., "Exploiting the mutanome for tumor vaccination", Cancer Res., 72, pp. 1081-1091 (2012).

Chafekar, et al., "MERS-CoV: Understanding the Latest Human Coronavirus Threat," Viruses, 10, 93, 22 pages (Feb. 24, 2018).

Chavan et al., "Expression of CCL20 and granulocyte-macrophage colony-stimulating factor, but not Flt3-L, from modified vaccinia virus Ankara enhances antiviral cellular and humoral immune responses," J. Virology, vol. 80, No. 15, pp. 7676-7687 (2006).

(56) References Cited

OTHER PUBLICATIONS

Chi et al., "DNA vaccine encoding Middle East respiratory syndrome coronavirus S1 protein induces protective immune responses in mice," Vaccine, vol. 35, pp. 2069-2075 (Apr. 11, 2017).
Coffey et al., "Reovirus therapy of tumors with activated Ras pathway," Science, 282, pp. 1332-1334 (1998).
Curran et al, Tumor Vaccines Expressing Flt2 Ligand Synergize with CTLA-4 Blockade to Reject Preimplanted Tumors, Cancer Research vol. 69 No. 19, Sep. 8, 2009, pp. 7747-7755.
Dai et al., "Abstract B031: Heat-inactivated modified vaccinia virus Ankara induces type I IFN and antitumor immunity via the cytosolic DNA-sensing pathway," retrieved from: http://www.cancerimmunolrres.aacrjournals.org/content/4/1_Supplement/B031 (Jun. 15, 2018).
Dai et al., "Intratumoral delivery of inactivated modified vaccinia virus Ankara (iMVA) induces systemic antitumor immunity via STING and Batf3-dependent dendritic cells" Science Immunology, vol. 2, No. 11, pp. 1-34 (May 19, 2017).
Dai, P et al, Modified Vaccinia Virus Ankara Triggers Type 1 IFN Production in Murine Conventional Dendritic Cells Via A cGAS/STING-Mediated Cytosolic DNA-Sensing Pathway, PLOS Pathogens, Apr. 2014, vol. 10, pp. 1-13.
Dai, P et al, Myxoma Virus Induces Type 1 Interferon Production in Murine Plasmacytoid Dendritic Cells Via A TLR9/MyD88-, IRF5/IRF7-, and IFNAR-Dependent Pathway. Journal of Virology, Oct. 2011, pp. 10814-10825.
Deng et al., "STING-Dependent Cytosolic DNA Sensing Promotes Radiation-Induced Type I Interferon-Dependent Antitumor Immunity in Immunogenic Tumors", Immunity, vol. 41, No. 5, pp. 843-852 (2014).
Deng et al., "Vaccinia virus infection attenuates innate immune responses and antigen presentation by epidermal dendritic cells", J Virol., 80, pp. 9977-9987 (2006).
Diamond et al., "Type I interferon is selectively required by dendritic cells for immune rejection of tumors", J Exp Med., vol. 208, No. 10, pp. 1989-2003 (2011).
Drexler et al., "Modified Vaccinia Virus Ankara for Delivery of Human Tyrosinase as Melanomaassociated Antigen: Induction of Tyrosinase- and Melanoma-specific Human Leukocyte Antigen A*0201-restricted Cytotoxic T Cells in Vitro and in Vivo1," Cancer Research, vol. 59, p. 4955-4963 (Oct. 1, 1999).
Drillien et al, Modified vaccination virus Ankara induces moderate activation of human dendritic cells, Journal of General Virology, Society for General Microbiology, vol. 85, No. Pt 8, Aug. 1, 2004, pp. 2167-2175.
Du et al., "The spike protein of SARS-CoV—a target for vaccine and therapeutic development," Microbiology, vol. 7, pp. 226-236 (Mar. 2009).
Engelmayer et al., "Vaccinia virus inhibits the maturation of human dendritic cells: a novel mechanism of immune evasion", J Immunol., 163, pp. 6762-6768 (1999).
Espenschied J et al, "CTL-4 blockade enhances the therapeutic effect of an attenuated poxvirus vaccine targeting p53 in in established murine tumor model", Journal of Immunology, vol. 170, Issue 6, pp. 3401-3407.
Fishcer et al., "Modified vaccinia virus Ankara protein F1L is a novel BH3-domain-binding protein and acts together with the early viral protein E3L to block virus-associated apoptosis" Cell Death Differ., 13, pp. 109-118 (2006).
Fuertes et al., "Host type I IFN signals are required for antitumor CD8 T-cell responses through CD8{alpha} dendritic cells", J. Exp. Med., vol. 208, No. 10, 2005-2016 (2011).
Fuertes et al., "Type I interferon response and innate immune sensing of cancer," Trends Immunol., vol. 34, No. 2, pp. 67-73 (Feb. 2013).
Fung et al., "Human Coronavirus: Host-Pathogen Interaction," Annual Review of Microbiology, 73, pp. 529-557 (Jun. 21, 2019).
Gao et al., "Structure-function analysis of STING activation by c[G(2',5')pA(3',5')p] and targeting by antiviral DMXAA", Cell, 154, pp. 748-762 (2013).
Garcia et al., "Safety and immunogenicity of a modified pox vector-based HIV/AIDS vaccine candidate expressing Env, Gag, Pol and Nef proteins of HIV-1 subtype B (MVA-B) in healthy HIV-1-uninfected volunteers: A phase I clinical trial (RISVAC02)", Vaccine, 29, pp. 8309-8316 (2011).
Garrido et al., "The escape of cancer from T lymphocytes: immunoselection of MHC class I loss variants harboring structural-irreversible "hard" lesions," Cancer Immunol. Immunother., 59, pp. 1601-1606 (2010).
GenBank: U94848.1 "Vaccinia virus strain Ankara, complete genomic sequence" p. 1-3 (Apr. 13, 2003).
Gerlini et al., "Metastatic melanoma secreted IL-10 down-regulates CD1 molecules on dendritic cells in metastatic tumor lesions", Am J Pathol., 165, pp. 1853-1863 (2004).
Gitlin et al., "Essential role of mda-5 in type I IFN responses to polyriboinosinic: polyribocytidylic acid and encephalomyocarditis picornavirus", Proc. Natl. Acad. Sci. U S A., vol. 103, No. 22, pp. 8459-8464 (May 30, 2006).
Goepfert et al., "Phase 1 safety and immunogenicity testing of DNA and recombinant modified vaccinia Ankara vaccines expressing HIV-1 virus-like particles", J Infect Dis., 203, pp. 610-619 (2011).
Gomez et al., "MVA and NYVAC as vaccines against emergent infectious diseases and cancer," Current Gene Therapy, vol. 11, No. 3, p. 189-217 (Jun. 2011).
Gomez et al., "The poxvirus vectors MVA and NYVAC as gene delivery systems for vaccination against infectious diseases and cancer", Curr Gene Ther., 8, pp. 97-120 (2008).
Greiner et al. "The highly attenuated vaccinia virus strain modified virus Ankara induces apoptosis in melanoma cells and allows bystander dendritic cells to generate a potent anti tumoral immunity" Clinical and Experimental Immunology vol. 146. No. 2, Nov. 1, 2006 pp. 344-353.
Guerra et al., "Distinct gene expression profiling after infection of immature human monocyte-derived dendritic cells by the attenuated poxvirus vectors MVA and NYVAC," J. of Virology, vol. 61, No. 16, pp. 8701-8721 (May 30, 2007).
Guerra et al., "Host-Range Restriction in Vaccinia Virus E3L Deletion Mutant Can Be Overcome In Vitro, but Not In Vivo, by Expression of the Influenza Virus NS1 Protein," PLoS One. vol. 6 No. 12, p. e28677 (2011).
Haagmans, et al., "An orthopoxvirus-based vaccine reduces virus excretion after MERS-CoV infection in dromedary camels," Science, vol. 351, pp. 77-81 (Jan. 1, 2016).
Hamid et al., "Safety and Tumor Responses with Lambrolizumab (Anti-PD-1) in Melanoma", The New England journal of medicine, vol. 369, No. 2, pp. 134-144 (2013).
Hammerich et al., In situ vaccination for the treatment of cancer, Immunotherapy vol. 8, No. 3, Mar. 1, 2016, pp. 315-330.
Harrop et al., "Vaccination of Colorectal Cancer Patients with Modified Vaccinia Ankara Delivering the Tumor Antigen 5T4 (TroVax) Induces Immune Responses which Correlate with Disease Control: A Phase I/II Trial," Clinical Cancer Research, vol. 12, No. 11 Pt. 1, p. 3416-6424 (Jun. 1, 2006).
Hodge et al., "Modified Vaccinia Virus Ankara Recombinants Are as Potent as Vaccinia Recombinants in Diversified Prime and Boost Vaccine Regimens to Elicit Therapeutic Antitumor Responses," American Association for Cancer Research, vol. 63, No. 22, p. 7942-7949 (Nov. 15, 2003).
Hodi et al., "Improved survival with ipilimumab in patients with metastatic melanoma", The New England journal of medicine, 363, pp. 711-723 (2010).
Holshue et al., "First Case of 2019 Novel Coronavirus in the United States," New England Journal of Medicine, 9 pages (Jan. 31, 2020).
Hornemann et al., "Replication of Modified Vaccinia Virus Ankara in Primary Chicken Embryo Fibroblasts Requires Expression of the Interferon Resistance Gene E3L," Journal of Virology, vol. 77, No. 15, p. 8394-8407 (Aug. 2003).
Huber et al., "Regulation of effector and memory T-cell functions by type I interferon", Immunology, 132, pp. 466-474 (2011).
Inman, "Immunotherapy/Targeted Therapy Combinations Show Promise in BRAF-Mutated Melanoma," Targeted Oncology, retrieved from: https://www.targetedonc.com/conference/smr-esmo-melanoma/

(56) References Cited

OTHER PUBLICATIONS immunotherapytargeted-therapy-combinations-show-promise-in-brafmutated-melanoma (Oct. 20, 2017).
International Search Report and Written Opinion on PCT/US2016/028184, dated Sep. 9, 2016, 17 pages.
International Search Report and Written Opinion on PCT/US2017/019548, dated Aug. 8, 2017, 17 pages.
International Search Report and Written Opinion on PCT/US2017/019549, dated Aug. 14, 2017 (17 pages).
International Search Report and Written Opinion on PCT/US2018/032451, dated Aug. 23, 2018, 16 pages.
International Search Report and Written Opinion on PCT/US2018/059476, dated Feb. 14, 2019, 9 pages.
International Search Report and Written Opinion, PCT/US2019/021853, Memorial Sloan Kettering Cancer Center (Jul. 16, 2019).
International Search Report and Written Opinion, PCT/US2019/051343 (Feb. 7, 2020).
Ishikawa et al., "STING is an endoplasmic reticulum adaptor that facilitates innate immune signaling", Nature, 455, pp. 674-678 (2008).
Jacobs et al., Vaccinia virus vaccines: Past, present and future, Antiviral Research, Elsevier BV, NL vol. 84, No. 1, Oct. 1, 2009 pp. 1-13.
Jenne et al., "Poxvirus as a vector to transduce human dendritic cells for immunotherapy: abortive infection but reduced APC function", Gene therapy, 7, pp. 1575-1583 (2000).
Jochems et al., "Tumor-infiltrating immune cells and prognosis: the potential link between conventional cancer therapy and immunity", Exp Biol Med.(Maywood), 236, pp. 567-579 (2011).
Kibler et al., "Double-stranded RNA is a trigger for apoptosis in vaccinia virus-infected cells", J. Virol., vol. 71, No. 3, pp. 1992-2003 (1997).
Kirn et al., "Replication-selective virotherapy for cancer: Biological principles, risk management and future directions," Nat. Med., 7, pp. 781-787 (2001).
Kirn et al., "Targeted and armed oncolytic poxviruses: a novel multi-mechanistic therapeutic class for cancer," Nature Reviews—Cancer, 9, pp. 64-71 (2009).
Kirn et al., "Targeting of interferon-beta to produce a specific, multi-mechanistic oncolytic vaccinia virus", PLoS Med., vol. 4, No. 12, pp. 2001-2012 (2007).
Kuzu et al., "Current State of Animal (Mouse) Modeling in Melanoma Research," Cancer Growth and Metastasis, 8(S1):81-94 (2015).
Lacy et al., "Immunotherapy for Melanoma," Expert Rev. Dermatol., 7, pp. 51-68 (2012).
Langland et al., "Inhibition of PKR by vaccinia virus: role of the N- and C-terminal domains of E3L," Journal of Virology, vol. 324, No. 2, p. 419-429 (Jul. 1, 2004).
Leach et al., "Enhancement of antitumor immunity by CTLA-4 blockade," Science, 271, pp. 1734-1736 (1996).
Lee et al., "The interferon-induced double-stranded RNA-activated protein kinase induces apoptosis," Journal of Virology, vol. 199, No. 2, p. 491-496 (Mar. 1994).
Lee et al., "Effect of resveratrol on the metastasis of 4T1 mouse breast cancer cells in vitro and in vivo," Nutrition Res. and Practice, vol. 6, No. 4, pp. 294-300 (2012).
Li et al., "Angiotensin-converting enzyme 2 is a functional receptor for the SARS coronavirus," Nature, vol. 426, pp. 450-454 (Nov. 27, 2003).
Li et al., "Disruption of MHC class II-restricted antigen presentation by vaccinia virus," J. Immunol., 175, pp. 6481-6488 (2005).
Li et al., "Early Transmission Dynamics in Wuhan, China, of Novel Coronavirus—Infected Pneumonia," New England Journal of Medicine, 9 pages (Jan. 29, 2020).
Li et al., "Pivotal roles of cGAS-cGAMP signaling in antiviral defense and immune adjuvant effects", Science, 341, pp. 1390-1394 (2013).
Li et al., "Structure of SARS Coronavirus Spike Receptor-Binding Domain Complexed with Receptor," Science, vol. 309, pp. 1864-1868 (Sep. 16, 2005).
Liu et al., "Deletion of C7L and K1L genes leads to significantly decreased virulence of recombinant vaccinia cirus TianTian," PLoS One, vol. 8, No. 7:e68115, pp. 1-13 (Jul. 1, 2013).
Liu, "Cancer-killing virus plus PD-1 and MEK inhibitors make for a 3-pronged attack on melanoma," retrieved from: https://www.fiercebiotech.com/research/pd-1-mek-inhibitor-and-anti-cancer-virus-a-3-pronged-attack-melanoma, 2 pages (Dec. 12, 2018).
Ludwig et al., "Role of Viral Factor E3L in Modified Vaccinia Virus Ankara Infection of Human HeLa Cells: Regulation of the Virus Life Cycle and Identification of Differentially Expressed Host Genes," Journal of Virology, vol. 79, No. 4, p. 2584-2596 (Feb. 2005).
Mandl, SJ et al, Immunotherapy With MVA-BN-HER2 Induces HER-2-specific Th1 Immunity and Alters the Intratumoral Balance of Effector and Regulatory T cells. Cancer Immunol Immunother, 2012, vol. 61, pp. 19-29.
Mayr et al., English-language translation of Abstract of: "[The smallpox vaccination strain MVA: marker, genetic structure, experience gained with the parenteral vaccination and behavior in organisms with a debilitated defence mechanism (author's transl)]," Zentralbl Bakteriol, Orig. B, 167, pp. 375-390 (1978).
Mayr et al., English-language translation of Abstract of: "Passage history, properties, and applicability of the attenuated vaccinia virus strain MVA," Infection, 3, pp. 6-14 (1975).
McCart et al., "Systemic Cancer Therapy with a Tumor-selective Vaccinia Virus Mutant Lacking Thymidine Kinase and Vaccinia Growth Factor Genes.", Cancer Res., (2001), 61, [24], p. 8751-8757.
McIntyre et al., "Mouse models of colorectal cancer as preclinical models," Bioessays, 37(8), pp. 909-920 (Aug. 2015).
Mellman et al., "Cancer immunotherapy comes of age", Nature, 480, pp. 480-489 (2011).
Meng et al., "C7L Family of Poxvirus Host Range Genes Inhibits Antiviral Activities Induced by Type I Interferons and Interferon Regulatory Factor 1", J. Virol., vol. 86, No. 8, pp. 538-4547 (2012).
Meng et al., "Vaccinia Virus K1L and C7L Inhibit Antiviral Activities Induced by Type I Interferons," Journal of Virology, vol. 83, No. 20, p. 10627-10636 (Oct. 2009).
Meyer et al., "Mapping of deletions in the genome of the highly attenuated vaccinia virus MVA and their influence on virulence", J. Gen. Virol., 72 ( Pt 5), pp. 1031-1038 (1991).
Mlecnik et al., "Tumor immunosurveillance in human cancers", Cancer Metastasis Rev, 30, pp. 5-12 (2011).
Morales et al., Genome comparison of a nonpathogenic myoxma virus field strain with its ancestor, the virulent Lausanne strain, J. Virol, vol. 83, No. 5, pp. 2397-2403 Mar. 2009.
Morales, et al., "Genome comparison of a nonpathogenic myxoma virus field strain with its ancestor, the virulent Lausanne strain." J. Virol. Mar. 2009, vol. 83, No. 5, pp. 2397-2403.
Moss, "Poxviridae: The viruses and their replication," In Fields Virology (Lippincott Williams & Wilkins), pp. 2905-2946 (2007).
Nagaria et al., "Combined targeting of RAF and MEK synergistically inhibits tumorigenesis in triple negative breast cancer model systems," Oncotarget, vol. 8, No. 46, pp. 80804-80819 (Aug. 24, 2017).
Nagorsen et al., "Transcriptional analysis of tumor-specific T-cell responses in cancer patients," Crit. Rev. Immunol., 22, pp. 449-462 (2002).
Nakayama et al., "In vitro comparison between mouse B16 and human melanoma cell lines of the expression of ICAM-1 induced by cytokines and/or hyperthermia," J. Dermatol., 24(6), pp. 351-360 (Jun. 1997).
Nemunaitis, J., "Oncolytic viruses,". Invest. New Drugs, 17, pp. 375-386 (1999).
Oble et al., "Focus on TILs: prognostic significance of tumor infiltrating lymphocytes in human melanoma", Cancer immunity, 9, pp. 1-20 (2009).
Pardoll, "The blockade of immune checkpoints in cancer immunotherapy," Nat. Rev. Cancer, 12(4), pp. 252-264 (Mar. 22, 2012).
Park et al., "Use of a targeted oncolytic poxvirus, JX-594, in patients with refractory primary or metastatic liver cancer: a phase I trial," Lancet Oncol., 9, pp. 533-542 (May 19, 2008).

(56) References Cited

OTHER PUBLICATIONS

Peggs et al., "Blockade of CTLA-4 on both effector and regulatory T-cell compartments contributes to the antitumor activity of anti-CTLA-4 antibodies", J Exp Med., 206, pp. 1717-1725 (2009).
Peihong et al., "Modified Vaccinia Virus Ankara Triggers Type I IFN Production in Murine Conventional Dendritic Cells via a cGAS/STING-Mediated Cytosolic DNA-Sensing Pathway," PLOS Pathogens, vol. 10, No. 4, p. e1003989 (Apr. 17, 2014).
Peihong, "P339 Intratumoral delivery of modified vaccinia virus Ankara expressing human Flt3L as cancer immunotherapy," 31st Annual Meeting and Associated Programs of the Society for Immunotherapy of Cancer, Pt. 2, p. 1-241 (2016).
Peiris, et al., "The Severe Acute Respiratory Syndrome," New England Journal of Medicine, vol. 349, pp. 2431-2441 (Dec. 18, 2003).
Perkus et al., "Vaccinia virus host genes," Virology, 179(1), pp. 276-286 (1990).
Pramanick et al., "Excipient selection in parenteral formulation development", Pharma Times, vol. 45, No. 3, pp. 65-77 (2013).
Raj et al., "Dipeptidyl peptidase 4 is a functional receptor for the emerging human coronavirus—EMC," Nature, vol. 495, 6 pages (Mar. 13, 2013).
Reddy et al., "Influences of BRAF Inhibitors on the Immune Microenvironment and the Rationale for Combined Molecular and Immune Targeted Therapy," Curr. Oncol. Rep., 18(7)15 pages (Jul. 2016).
Robert et al., "Ipilimumab plus dacarbazine for previously untreated metastatic melanoma", The New England journal of medicine, 364, pp. 2517-2526 (2011).
Sabbatino et al., "Antitumor activity of BRAF inhibitor and IFN combination in BRAF-mutant melanoma," J. Natl. Cancer Inst., 108(7), 11 pages (Feb. 5, 2016).
Sato et al., "Distinct and essential roles of transcription factors IRF-3 and IRF-7 in response to viruses for IFN-alpha/beta gene induction", Immunity, 13, pp. 539-548 (2000).
Sauer et al., "The N-ethyl-N-nitrosourea-induced Goldenticket mouse mutant reveals an essential function of Sting in the in vivo interferon response to Listeria monocytogenes and cyclic dinucleotides", Infection and immunity, vol. 79, No. 2, pp. 688-694 (2011).
Schaedler et al., "Sequential administration of a MVA-based MUC1 cancer vaccine and the TLR9 ligand Litenimod (Li28) improves local immune defense against tumors," Vaccine, vol. 35, No. 4, p. 577-585 (Jan. 23, 2017).
Schumacher et al., "Neoantigens in cancer immunotherapy", Science, 348, pp. 69-74 (2015).
Sharma et al., "The future of immune checkpoint therapy", Science, 348, pp. 56-61 (2015).
Sivan et al., "Identification of Restriction Factors by Human Genome-Wide RNA Interference Screening of Viral Host Range Mutants Exemplified by Discovery of SAMD9 and WDR6 as Inhibitors of the Vaccinia Virus K1L-C7L-Mutant", mBio, vol. 6, No. 4, pp. 1-9 (2015).
Song, et al., "Middle East Respiratory Syndrome Coronavirus Spike Protein Delivered by Modified Vaccinia Virus Ankara Efficiently Induces Virus-Neutralizing Antibodies," Journal of Virology, vol. 87, pp. 11950-11954 (Nov. 2013).
Sun et al., "Cyclic GMP-AMP synthase is a cytosolic DNA sensor that activates the type I interferon pathway", Science, 339, pp. 786-791 (2013).
Sutter et al., "Vaccinia vectors as candidate vaccines: the development of modified vaccinia virus Ankara for antigen delivery," Current Drug Targets—Infectious Disorders 3, pp. 263-271 (2003).
Tagliamonte et al., "Antigen-specific vaccines for cancer treatment", Human vaccines & immunotherapeutics, 10, pp. 3332-3346 (2014).
Takaoka et al., "New aspects of IFN-alpha/beta signalling in immunity, oncogenesis and bone metabolism", Cancer Sci., vol. 94, No. 5, pp. 405-411 (2003).
Thorne et al., "Rational strain selection and engineering creates a broad-spectrum, systemically effective oncolytic poxvirus, JX-963", J Clin Invest., vol. 117, No. 11, pp. 3350-3358 (2007).
Topalian et al., "Immune checkpoint blockade: a common denominator approach to cancer therapy", Cancer Cell, vol. 27, No. 4, pp. 450-461 (2015).
Topalian et al., "Targeting the PD-1/B7-H1(PD-L1) pathway to activate anti-tumor immunity", Curr Opin Immunol., 24, pp. 207-212 (2012).
Tormo et al., "Targeted activation of innate immunity for therapeutic induction of autophagy and apoptosis in melanoma cells", Cancer Cell, vol. 16, No. 2, pp. 103-114 (2009).
Tumeh et al., "PD-1 blockade induces responses by inhibiting adaptive immune resistance", Nature, vol. 515, No. 7258, pp. 568-571 (2014).
Ventura et al Abstracts/Adaptive Immunity and Vaccination, Journal of Investigative Dermatology 2016 vol. 136 p. S6.
Verardi et al., "A vaccinia virus renaissance: new vaccine and immunotherapeutic uses after smallpox eradication", Human vaccines & immunotherapeutics, 8, pp. 961-970 (2012).
Verheust et al., "Biosafety aspects of modified vaccinia virus Ankara (MVA)-based vectors used for gene therapy or vaccination," Vaccine, 30, pp. 2623-2632 (2012).
Vijaysri et al., "Vaccinia Viruses with Mutations in the E3L Gene as Potential Replication-Competent, Attenuated Vaccines: Intra-Nasal Vaccination," Vaccine, vol. 26, No. 5, p. 664-676 (Jan. 30, 2008).
Volz, et al., "Protective Efficacy of Recombinant Modified Vaccinia Virus Ankara Delivering Middle East Respiratory Syndrome Coronavirus Spike Glycoprotein," Journal of Virology, vol. 89, pp. 8651-8656 (Aug. 2015).
Waibler et al., "Modified Vaccinia Virus Ankara Induces Toll-Like Receptor-Independent Type I Interferon Responses," Journal of Virology, vol. 81, No. 22, p. 12101-12110 (Nov. 2007).
Wang et al., "034 recombinant replication competent attenuated vaccinia virus expressing human Flt3L for cancer immunotherapy," J. Invest. Derm., vol. 136, No. 5, p. S6 (May 2016).
Wang et al., Abstracts-Adaptive Immunity and Vaccination 034, Recombinant replication competent attenuated vaccinia virus expressing human Flt3L for cancer immunotherapy, Journal of Investigative Dermatology vol. 136, No. 5 May 2016 p. S6.
Weaver et al., "The identification and characterization of a monoclonal antibody to the vaccinia virus E3 protein", Virus Res., 130, pp. 269-274 (2007).
Wing et al., "CTLA-4 control over Foxp3 regulatory T-cell function", Science, 322, pp. 271-275 (2008).
Wolchok et al., "Ipilimumab monotherapy in patients with pretreated advanced melanoma: a randomised, double-blind, multicentre, phase 2, dose-ranging study," Lancet Oncol., 11, pp. 155-164 (2010).
Wolchok et al., "Nivolumab plus ipilimumab in advanced melanoma", The New England journal of medicine, 369, pp. 122-133 (2013).
Woo et al., "STING-dependent cytosolic DNA sensing mediates innate immune recognition of immunogenic tumors", Immunity, vol. 41, No. 5, pp. 830-842 (2014).
Wu et al., "Cyclic GMP-AMP is an endogenous second messenger in innate immune signaling by cytosolic DNA", Science, 339, pp. 826-830 (2013).
Wyatt et al., "Enhanced cell surface expression, immunogenicity and genetic stability resulting from a spontaneous truncation of HIV Env expressed by a recombinant MVA", Virology, 372, pp. 260-272 (2008).
Yong, et al., "Recent Advances in the Vaccine Development Against Middle East Respiratory Syndrome-Coronavirus," Frontiers in Microbiology, vol. 10, 18 pages (Aug. 2, 2019).
Zaki, et al., "Isolation of a Novel Coronavirus from a Man with Pneumonia in Saudi Arabia," The New England Journal of Medicine, vol. 367, pp. 1814-1820 (Nov. 8, 2012).
Zamarin et al., "Localized oncolytic virotherapy overcomes systemic tumor resistance to immune checkpoint blockade immunotherapy", Science translational medicine, vol. 6, No. 226, pp. 1-12 (2014).

(56) References Cited

OTHER PUBLICATIONS

Zhang, et al., "A DNA vaccine induces SARS coronavirus neutralization and protective immunity in mice," Nature, vol. 428, pp. 561-564 (Apr. 2004).
Zhou, et al., "A pneumonia outbreak associated with a new coronavirus of probable bat origin," Nature, 23 pages (Feb. 3, 2020).
Zurkova et al., "The expression of the soluble isoform of hFlt3 ligand by recombinant vaccinia virus enhances immunogenicity of the vector," vol. 21, No. 5, p. 1335-1343 (Apr. 6, 2009).
Kreiter et al., "Mutant MHC class II epitopes drive therapeutic immune responses to cancer." Nature. Apr. 22, 2015, vol. 520, No. 7549, pp. 692-696.
Lee SY et al. Intratumoral injection of therapeutic H PV vaccinia vaccine following cisplatin enhances H PV-specific anti tumor effects. Cancer Immunol Immunother (2013) 62: 1175-1185 (Year: 2013).
Reuschenbach M et al. High-risk human papillomavirus in non-melanoma skin lesions from renal allograft recipients and immunocompetent patients. British Journal of Cancer 2011 104, 1334-1341 (Year: 2011).
Rice et al. An H PV-E6/E7 immunotherapy plus PD-1 checkpoint inhibition results in tumor regression and reduction in PD-L 1 expression. Cancer Gene Therapy (2015) 22, 454-462.
Carroll et al., "Highly attenuated modified vaccinia virus Ankara (MVA) as an effective recombinant vector: a Murine tumor model", Vaccine, 15(4), pp. 387-394, 31.
Greiner et al., "The blockade of immune checkpoints in cancer immunotherapy", Nat Rev Cancer, 12(4), pp. 252-264, Mar. 22, 2012 (Mar. 22, 2012).
Kwissa et al., "Adjuvanting a DNA vaccine with a TLR9 ligand plus Flt3 ligand results in enhanced cellular immunity against the simian immunodeficiency virus." J. Exp. Medicine. Oct. 29, 2007, vol. 204, No. 11, pp. 2733-2746.
Fang J et al: "Stable antibody expression at therapeutic levels using the 2A peptide", Nature Biotechnology, Nature Publishing Group US, New York, vol. 23, No. 5, Apr. 17, 2005 (Apr. 17, 2005) , pp. 584-590.
T Du et al: "Tumor-specific oncolytic adenoviruses expressing granulocyte macrophage colony-stimulating factor or anti-CTLA4 antibody for the treatment of cancers", Cancer Gene Therapy, vol. 21, No. 8, Jul. 18, 2014 (Jul. 18, 2014), pp. 340-348.
Wang Weiyi et al: "LB-306: Oncolytic vaccinia virus expressing immune checkpoint blockade antibody as cancer immunotherapeutics", Cancer Research; Annual Meeting of the American-Association-For-Cancer-Research (AACR), American Association for Cancer Research, US; Chicago, IL, USA, vol. 78, No. 13, Suppl . S, Jun. 30, 2018 (Jun. 30, 2018), pp. LB-306.
Wu, et al., "Structure and function of vaccinia virus E3L protein." Journal of Biology, No. 2, pp. 64-83, (Apr. 13, 2013).
Dai et al. Abstract B031: Heat-inactivated modified vaccinia virus ankara induces type I IFN and antitumor immunity via the cytosolic DNA-sensing pathway. (Cancer Immunol Res (2016) (1_Supplement): B031) (Year: 2016).
Diao et al., "Vaccine Application and Safety Q&A." China Pharmaceutical Science and Technology Press, pp. 35-36, Apr. 30, 2017.
Goldufsky et al. "Oncolytic virus therapy for cancer." Oncolytic Virotherapy. Sep. 23, 2023, No. 2, pp. 31-46.
Nemeckova et al. "Experimental therapy of HPV16 induced tumors with IL12 expressed by recombinant vaccinia virus in mice." International Journal of Molecular Medicine. 2003, No. 12, pp. 789-796.
O'Sullivan et al. "Cancer immunoediting by the innate immune system in the absence of adaptive immunity." J. Exp. Med. Sep. 24, 2012, vol. 209, No. 10, pp. 1869-1882.
Sobhani et al. "Implications of photodynamic cancer therapy: an overview of PDT mechanisms basically and practically." J. Egypt Natl. Canc. Inst. Web. Nov. 15, 2021, pp. 1-13.
Vu et al. "Cancer Resistance to Immunotherapy: Molecular Mechanisms and Tackling Strategies." Int. J. Mol. Sci. Sep. 18, 2022, pp. 1-22.
Wang et al. Abstract A007: Intratumoral delivery of inactivated vaccinia virus is more efficacious than live oncolytic vaccinia virus in murine bilateral tumor implantation models. (Cancer Immunol Res (2016) 4 (11_Supplement): A007) (Year: 2016).
Gomez CE, Perdiguero B, Garcfa-Arriaza J, Esteban M. Clinical applications of attenuated MVA poxvirus strain. Expert Rev Vaccines. Dec. 2013; 12(12):1395-416. (Year: 2013).

* cited by examiner

Injected tumors

Non-injected tumors

Injected tumors

Non-injected tumors

B16-F10

| PBS | MVAΔC7L-h FLT3L-muOX 40L | MVAΔC7L-h FLT3L-muOX 40L+ αCTLA-4 | MVAΔC7L-h FLT3L-muOX 40L+αPD-L1 |
|---|---|---|---|
| 7 | 14 | 21 | 26.5 |

FIG. 22

VacciniavirusstrainAnkara,completegenomicsequence(GenBankAccessionNo.:U94848.1;
SEQIDNO:1)

```
   1 gtaagattaa attaattata aaattatgta tataatatta attataaaat tatgtatatg
  61 atttactaac tttagttaga taaattaata atacataaat tttagtatat taatattata
 121 aattaataat acataaattt tagtatatta atattatatt ttaaatattt atttagtgtc
 181 tagaaaaaaa tgtgtgacca acgaccgtag gaaactctag agggtaagaa aaatcaatcg
 241 ctttatagag accatcagaa agaggtttaa tatttttgtg agaccatcga aggagaaaga
 301 gataaaactt ttttacgact ccatcagaaa gaggtttaat atttttgtga gaccatcgaa
 361 gagagaaaga gataaaactt ttttacgact ccatcagaaa gaggtttaat atttttgtga
 421 gaccatcgaa gagagaaaga gataaaactt ttttacgact ccatcagaaa gaggtttaat
 481 atttttgtga gaccatcgaa ggagaaagag ataaaacttt tttacgactc catcagaaag
 541 aggtttaata tttttgtgag accatcgaag gagaaagaga taaaactttt ttacgactcc
 601 atcagaaaga ggtttaatat ttttgtgaga ccatcgaagg agaaagagat aaaacttttt
 661 tacgactcca tcagaaagag gtttaatatt tttgtgagac catcgaagag agaaagagat
 721 aaaacttttt tacgactcca tcagaaagag gtttaatatt tttgtgagac catcgaagga
 781 gaaagagata aaactttttt acgactccat cagaaagagg tttaatattt ttgtgagacc
 841 atcgaagaga gaaagagaat aaaaatattt tagtgacacc atcagaaaga ggtttaatat
 901 ttttgtgaga ccatcgaaga gagaaagaga taaaactttt ttacgactcc atcagaaaga
 961 ggtttaatat ttttgtgaga ccatcgaagg agaaagagat aaaacttttt tacgactcca
1021 tcagaaagag gtttaatatt tttgtgagac catcgaagag agaaagagat aaaacttttt
1081 tacgactcca tcagaaagag gtttaatatt tttgtgagac catcgaagag agaaagagat
1141 aaaacttttt tacgactcca tcagaaagac catcgaagag agaaagagaa agagatagtt
1201 agtctagata tttttcttag tacaaaagtc aatgttttaa aatatatgga caagaatttg
```

FIG. 22 (CONT.)

```
1261 tctgtataaa aacttgtgtg aaattttgta ccaaagaaaa aatgtgagca gtatccccta
1321 catggatttt actagatcat ttatatacca aaaaatatta tacgatctac gttttattat
1381 atgattttaa cgtgtaaatt ataaacatta ttttatgata tacaattgtc tggtaaccta
1441 gatgggcata ggggatgagt atatgttgtt ggacgttatt gtttaagaaa tagttgatgc
1501 atcagaaaga ggtttaatat ttttgtgaga ccatcgaaga gagaaagaga taaaactttt
1561 ttacgactcc atcagaaaga ggtttaatat ttttgtgaga ccatcgaaga gagaaagaga
1621 taaaactttt ttatgactcc attgaagaga gaatgagaat aaaaatattt tagtgacacc
1681 atcagaaaga ggtttaatat tttttatgag accatcaaag agagaaagag aataaaaata
1741 ttttatgact ccattgaaga gagaaagaga aaatgagaat aaaaatattt tagtgacacc
1801 atcagaaaga ggtttaatat tttttatgag accatcaaag agagaaagag aataaaaata
1861 tttttgtaaa actttttta tgagaccatc aaagagagaa agagaataaa aatatttttg
1921 taaaactttt tttatgagac catcaaagag agaaagagaa taaaaatatt tttgtaaaac
1981 tttttttatg agaccatcaa agagagaaag agaataaaaa tatttttgta aaactttttt
2041 tatgagacca tcaaagagag aaagagaata aaaatatttt tgtaaaactt tttttatgag
2101 accatcaaag agagaaagag aataaaaata tttttgtaaa actttttta tgagaccatc
2161 aaagagagaa agagaataaa aatatttttg taaaactttt tttatgagac catcaaagag
2221 agaaagagaa taaaaatatt ttatgactcc attgaagaga gaaagagaat aaaaatattt
2281 tagtgacacc atcagaaaga ggtttaatat ttttgtgaga ccatcgaaga gagaaagaga
2341 ataaaaatat tttatgactc cattgaagag agaaagagaa taaaaatatt ttagtgacac
2401 catcagaaag aggtttaata ttttttatga gaccatcaaa gagagaaaga gaataaaaat
2461 atttttgtaa aacttttttt atgagaccat caaagagaga aagagaataa aaatattttt
```

FIG. 22 (CONT.)

```
2521 gtaaaacttt ttttatgaga ccatcaaaga gagaaagaga ataaaaatat ttttgtaaaa
2581 cttttttat gagaccatca aagagagaaa gagaataaaa atatttttgt aaaacttttt
2641 ttatgagacc atcaaagaga gaaagagaat aaaaatattt ttgtaaaact tttttatga
2701 gaccatcaaa gagagaaaga gaataaaaat attttatgac tccattgaag agagaatgag
2761 aataaaaata ttttagtgac accatcagaa agaggtttaa tatttttgtg agaccatcga
2821 agagagaaag agaataaaaa tattttatga ctccattgaa gagagaaaga gaataaaaat
2881 attttagtga caccatcaga aagaggttta atattttta tgagaccatc aaagagagaa
2941 agagaataaa aatattttg taaaactttt tttatgagac catcaaagag agaaagagaa
3001 taaaaatatt tttgtaaaac tttttttatg agaccatcaa agagagaaag agaataaaaa
3061 tatttttgta aaactttttt tatgagacca tcaaagagag aaagagaata aaaatatttt
3121 tgtaaaactt tttttatgag accatcaaag agagaaagag aataaaaata tttttgtaaa
3181 acttttttta tgagaccatc aaagagagaa agagaataaa aatattttg taaaactttt
3241 tttatgagac catcaaagag agaaagagaa taaaaatatt tttgtaaaac tttttttatg
3301 agaccatcaa agagagaaag agaataaaaa tattttatga ctccattgaa gagagaatga
3361 gaataaaaat attttagtga caccatcaga aagaggttta atatttttgt gagaccatcg
3421 aagagagaaa gagaataaaa atattttatg actccattga agagagaatg agaataaaaa
3481 tattttagtg acaccatcag aaagaggttt aatatttttt atgagaccat caaagagaga
3541 aagagaataa aaatattttt gtaaaacttt ttttatgaga ccatcaaaga gagaaagaga
```

FIG. 22 (CONT.)

```
3601 ataaaaatat ttttgtaaaa attataaaca ttattttatg atatacaatt gtctggtaac
3661 ctagatgggc ataggggatg ttgataagct cgacgagtat atgttgttgg acgttattgt
3721 ttaagaaata gttgatgcat cagaaagaga ataaaaaata ttttagtgag accatcgaag
3781 agagaaagag ataaaacttt tttacgactc catcagaaag aggtttaata tttttgtgag
3841 accatcgaag agagaaagag ataaaacttt tttacgactc catcagaaag aggtttaata
3901 tttttgtgag accatcgaag gagaaagaga taaaactttt ttacgactcc atcagaaaga
3961 ggtttaatat ttttgtgaga ccatcaaaga gagaaagaga ataaaaatat ttttgtaaaa
4021 cttttttat gagaccatca aagagagaaa gagaataaaa atatttttgt aaaacttttt
4081 ttatgagacc atcaaagaga gaaagagaat aaaaatattt ttgtaaaact tttttatga
4141 gaccatcaaa gagagaaaga gaataaaaat atttttgtaa aacttttttt atgagaccat
4201 caaagagaga aagagaataa aaatatttta tgactccatt gaagagagaa tgagaataaa
4261 aatattttag tgacaccatc agaaagaggt ttaatatttt tgtgagacca tcgaagagag
4321 aaagagaata aaaatatttt atgactccat tgaagagaga atgagaataa aaatatttta
4381 gtgacaccat cagaaagagg tttaatattt tttatgagac catcaaagag agaaagagaa
4441 taaaaatatt tttgtaaaac ttttttatg agaccatcaa agagagaaag agaataaaaa
4501 tatttttgta aaactttttt tatgagacca tcaaagagag aaagagaata aaaatatttt
4561 tgtaaaactt tttttatgag accatcaaag agagaaagag aataaaaata tttttgtaaa
4621 acttttttta tgagaccatc aaagagagaa agagaataaa aatattttat gactccattg
4681 aagagagaat gagaataaaa atattttagt gacaccatca gaaagaggtt taatattttt
4741 gtgagaccat cgaagagaga aagagaataa aaatatttta tgactccatt gaagagagaa
4801 agagaataaa aatattttag tgacaccatc agaaagaggt ttaatatttt ttatgagacc
```

FIG. 22 (CONT.)

```
4861 atcaaagaga gaaagagaat aaaaatattt ttgtaaaact tttttatga gaccatcaaa
4921 gagagaaaga gaataaaaat attttatgac tccattgaag agagaatgag aataaaaata
4981 ttttagtgac accatcagaa agaggtttaa tatttttgtg agaccatcga agagagaaag
5041 agaataaaaa tattttatga ctccattgaa gagagaatga gaataaaaat attttagtga
5101 caccatcaga aagaggttta atatttttgt gagaccatcg aagagagaaa gagaataaaa
5161 atattttatg actccattga agagagaatg agaataaaaa tattttagtg acaccatcag
5221 aaagaggttt aatatttttt atgagaccat caaagagaga aagagaataa aaatattttt
5281 gtaaaacttt ttttatgaga ccatcaaaga gagaaagaga ataaaaatat ttttgtaaaa
5341 cttttttat gagaccatca aagagagaaa gagaataaaa atatttttgt aaaacttttt
5401 ttatgagacc atcaaagaga gaaagagaat aaaaatattt ttgtgagacc atcaaagaga
5461 gaaagagaat aaaaatattt ttgtgagacc atcaaagaga gaaagagaat aaaaatattt
5521 ttgtgagacc atcaaagaga gaaagagaat aaaaatattt tatgactcca ttgaagagag
5581 aaagagaata aaaatatttt agtgacacca tcagaaagag gtttaatatt tttgtgagac
5641 catcgaagag agaaagagaa taaaaatatt ttatgactcc attgaagaga gaaagagaat
5701 aaaaatattt tagtgacacc atcagaaaga ggtttaatat tttttatgag accatcaaag
5761 agagaaagag aataaaaata tttttatga gaccatcaaa gagagaaaga gaataaaaat
5821 attttatgag accatcaaag agagaaagag aataaaaata tttttatga gaccatcaaa
5881 gagagaaaga gaataaaaat attttatgag accatcaaag agagaaagag aataaaaata
5941 tttttatga gaccatcaaa gagagaaaga gaataaaaat atttttgtat gagaccatca
6001 gaaagaggtt taatattttt gtgataccct gaaaggaaat aggaatagtg tcataatcgt
6061 atcacactat tgagacagaa aaagaagaag tcgcgagagg taacttttg ttttgcaaac
```

FIG. 22 (CONT.)

```
6121 cggaatatag tgtccggtac acttttttaa ttcgtggtgt gcctgaatcg ttcgattaac
6181 cctactcatc caatttcaga tgaatagagt tatcgattca gacacacgct ttgagttttg
6241 ttgaatcgat gagtgaagta tcatcggttg caccttcaga tgccgatccg tcgacatact
6301 tgacctcaag ttcagatgat tccttgcaca tgtctccgat acgaacgcta aactctagat
6361 tcttgacaca ttttgtatcg acgatcgttg aaccgatgat atcttcgtaa ctcactttct
6421 tatgagagat gttagacccg agtactggat gggtcttgat gtcgctgtct ttctcttctt
6481 cgctacatct gatgtcgata gacacctcac agtctttcca tcagcggatt ctgagatgga
6541 tttaatctga ggacatttgg tgaatccaaa gttcattctc agacctccac cgatgatgga
6601 gtaataagtg gtaggaggat ctacatcctc gactgattcc acctcgggat ctggatctga
6661 ctcggactct gtaatttccg ttacggattg gcaaatctta tcatcggtcg gtgtttggtc
6721 ttgctttgtg actttgataa taacatcgat tcccatatga tgtttgtttt cttcttccgt
6781 acacgatgag gatgattgct gaagactggc aggcacatgc atgccagtac gatatattgt
6841 ttcatgattg ctattgattg agtactgttc tttatgattc tacttcctta ccgtgcaata
6901 aattagaata tattttctac ttttacgaga aattaattat tgtatttatg ggtgaaaaac
6961 ttactataaa aagcgggtgg gtttggaatt agtgatcagt ttatgtatat cgcaactacc
7021 gggcatatgg ctacattacc cacatgataa gagattgtat cagtttcgta gtcttgagta
7081 ttggtattac tatatagtat atagatgtcg acgctagagt tactgtctcc gaatgcggca
7141 tgatagtatc attctttgct ttcgttaact gtttggagga agaatctttg ttattgcatt
7201 taatctcgaa attcagagtg cacacctttc tcctgtaaag aaacctgaag tcgctacctt
7261 attaagaaga cgggatcgca gtctttatga ttcatagtaa tagttagttc cgacgttgag
```

FIG. 22 (CONT.)

```
7321 atggattcgc tgagaccggt agtggtcgtc cgagtacacg atgtgtcgtt aactggatac
7381 aggttaattt ccacatcgat atagttaaag gtatttctgg gtacgggttc gcatttatct
7441 gcggaagaga cggtgtgaga atatgttccg agaccacacg gagaacagat gacgtctccg
7501 gatactccgt atcctattcc acattttgtt tgggaaacac atgccttgca tccatgatcg
7561 ggagagcatt cacagattct attgtgagtc gtgttacacg atcgcgtcga cattgttgac
7621 agaaacgtga ccttcattct taccgtcgtc cataaatacg ttaggtatgt accacatact
7681 gtcgcgaacg atgcgtccat ctcataatga tttacttttt cataattaaa gatgtgaaag
7741 aaaaccgaac aatatatttt tttagtaatg tttatgcgag acatataaaa taaactccgt
7801 gtttatgatg ccggtaaatg tttttatcat cttggacgga atcgattttg taatatgcca
7861 tggaaacagg acattatcac tccatgataa attatttaat ggagtcgatc ctctcattgt
7921 tctttgcgta tctcaatctg tggcgtttgc ttcgtttaaa taatatatca aacatggaga
7981 cgcctgatat gtaggcattc ttcattctat taatgtctgc tctatagcgc tttagttcct
8041 tatgacgacc ggcgatatca tacttacttt agaaggaaaa tcatcatcta ggattaaggc
8101 gtatctgata caggcgaata atggttcagg atatagatag cgtatatctc tattaaatgc
8161 gtcaatcata gtctctagag tgggatggta actcagtaat aaatcaacta gcttctcttt
8221 ggtaactgct tttctggatg gccgtattga ttatcgagcg tgacactcgc tccatattcc
8281 aataaccgct ttgcaaattg tatattattg acatcgaccg cgtaatatag tagagttatc
8341 gatcatatct atatcatcca tgtacttgct tagtatatca aatacatctt cataacagtg
8401 atacccgcaa ttattaaatc tcgataatat cagaccgtac atacatagac ggccattgtt
8461 agatatgtga tttacagccg cgtgtccata ttttccacga taaaccttac gacgtttaca
8521 tcgacgagat tattattaac aaagttgttg tccgtcgtct tatccaacat gcattgaatg
```

FIG. 22 (CONT.)

```
8581 ataggtatac ttaccatatc gccgtaatgt aagtagttta tcagtatggc ttgtacgatg
8641 gattcatcct gttgtctaaa tctctttaga atgttatcga tgatgtagtg gttatattct
8701 ctggaatcgt acgaagtaat actacgcatt acgtcgacaa gagtatgacg tctctcaata
8761 agaagattaa cgatttccat gtctacatta tatggggtta ctctaaatcg cttgtttaga
8821 taatacgcct ctaatatagg gctgacgtcg tatactctac acgtgtccac atcctttatt
8881 aataatctct atatctatgg ttgagcaaga ccagtagtat tggatggaaa cattgttatc
8941 gatcaaacat ttaattacat ccttggatag agattctcta tgagacgata tatagtaatg
9001 aagagagttc ttacacatat cactgttgta catacaggta cgaaatacgt aaccggtgct
9061 gtaacattct gatttaagaa gccatagcaa tacttctggt ctcggattag gcgtcgttac
9121 gtatatatcc accaatccga gaccattgat tgcataattc gtattcttgg acggacgtat
9181 ccgtttatcc acaattaggt attttagcag acgtaagtcg aaatcattta tattcgactt
9241 gagttcgtta gaggaattcg aatagctgga tatcagtaga tgcacaatct gagattttac
9301 gtatctatgc ttactgtatg ctcctagcgg agttaatcct tcgttgtttc tacaaagtct
9361 ctcgactccg cgagagagta acagtcgaac aatcttaatg tctgtatcgc atttattgga
9421 gacgtaacaa tgtagcgcat tgtttcctcg tctatctata tgttttgata agttgtgaca
9481 cgtttcaatt tctagtttta tttttttgta cgtcacatct tcatccagta gacgacatag
9541 aatacatgtg caatccatag ctattctggt gctaattatt cctcataaga tgataaaaag
9601 tgtagtgaga gagcatgaag gagatttagt atttagcagt gcggatatga tccaagaggg
9661 tgagatagtc gttctcgttc agaatctttc gcagcataag tagtatgtcg atatacttat
9721 cgttgaagac tcttccagag acgatagctg attgagtaca aagtccaatg attgcacgaa
9781 gttcttcggc ggttttcatg gagtcatttc tgatgaaaca tttaatgatc taaatttcag
```

FIG. 22 (CONT.)

9841 tttatgtttg taccccgtat tcatacttaa caaattggta ttacatacca ttaataatgc
9901 aagcataaaa aatcgttagt agatgtttct aaatataggt tccgtaagca aagaatataa
9961 gaatgaagcg gtaatgataa aatcaatcgt tatctaaaat gatcatactc atttatttta
10021 ttctattata ttaacacata catttttaac agcaacacat tcaatattgt attgttattt
10081 ttatattatt tacacaatta acaatatatt attagtttat attactgaat taataatata
10141 aaattcccaa tcttgtcata aacacacact gagaaacagc ataaacacaa aatccatcaa
10201 aaatgttgat aaattatctg atgttgttgt tcgctgctat gataatcaga tcattcgccg
10261 atagtggtaa cgctatcgaa acgacatcgc cagaaattac aaacgctaca acagatattc
10321 cagctatcag attatgcggt ccagagggag atggatattg tttacacggt gactgtatcc
10381 acgctagaga tatcgacggt atgtattgta gatgctctca tggttataca ggcattagat
10441 gtcagcatgt agtattagta gactatcaac gttcagaaaa accaaacact acaacgtcat
10501 atatcccatc tcccggtatt atgcttgtat tagtaggcat tattattatt acgtgttgtc
10561 tattatctgt ttataggttc actcgacgaa ctaaactacc tatacaagat atggttgtgc
10621 cataattttt ataaattttt tttatgagta tttttacaaa aatgtataaa gtgtatgtct
10681 tatgtatatt tataaaaatg ctaaatatgc gatgtatcta tgttatttgt atttatctaa
10741 acaatacctc tacctctaga tattatacaa aaattttta tttcggcata ttaaagtaaa
10801 atctagttac cttgaaaatg aatacagtgg gtggttccgt atcaccagta agaacataat
10861 agtcgaatac agtatccgat tgagattttg catacaatac tagtctagaa agaaatttgt
10921 aatcatcttc tgtgacggga gtccatatat ctgtatcatc gtcccatgct atattcctgt
10981 tatcatcatt agttaatgaa aataactctc gtgcttcaga aaagtcaaat attgtatcca

FIG. 22 (CONT.)

```
11041 tacatacatc tccaaaacta tcgcttatac gtttatcttt aacgatacct atacctagat
11101 ggttatttac taacagacat tttccagatc tattgactat aactcctata gtttccacat
11161 caaccaagta atgatcatct attgttatat aacaataaca taactctttt ccgtttttat
11221 cagtatgtat atctatatca acgtcgtcgt tgtagtgaat agtagtcatt gatctattat
11281 atgaaacgga tatgtctaga acggcaattg ttttacgtcc agttaacact ttcgttgatt
11341 taaagtctag agtctttgca aacataatat ccttatccga ctttatattt cctgtagggt
11401 ggtataattt tattttgcct ccacatatcg gtgtttccaa atatattact agacaatatt
11461 ccatatagtt attagttaag ggtacccaat tagaacacgt acgcttatta tcatcatttg
11521 gatcgtattt cataaaagtt attgtactat cgatgtcaac acattctaca tttttttaatc
11581 gtctatatag tatttttctg atattttcta taatatcaga attgtcttcc atcggaagtt
11641 gtatactatc ggaatcagtt acatgtttaa ataattctct gatgtcattc cttatacaat
11701 caaattcatt attaaacagt ttaatagtct gtagaccttt atcgtcgtaa atatccattg
11761 tcttattagt tacgcttatt tttatgtgtt tttacgttgc tttattatat tttataagaa
11821 tgattgtttg acgaatcacg agaactatta agacacatta ttaggtatat attataaaaa
11881 agtttttgat tacgatgtta taagaggaaa gaggacacat taacatcata catcaattaa
11941 ctacattctt ataacatcgt aatcaaaaga attgcaattt tgatgtataa caactgtcaa
12001 tgggttatgg aattgtatat tacatattat acggtatgtt ggtaacgaca aataccgatc
12061 ggtaattgtc tgccggtgta atagaattat atatatctat ctattacacc ggccttgtat
12121 acataataat aagttgtggt agtatgatct ccatatttat aatttaggac tttgtattca
12181 gtttttttgg aatcataaaa aataaaaaaa agttttacta atttaaaatt atttacattt
12241 ttttcactgt ttagtcgcgg atatggaatt cgatcctgcc aaaatcaata catcatctat
```

FIG. 22 (CONT.)

```
12301 agatcatgta acaatattac aatacataga tgaaccaaat gatataagac taacagtatg
12361 cattatcaca aaaataaatc cacatttggc taatcaattt cgggcttgga aaaaacgtat
12421 cgccggaagg gactatatga ctaacttatc tagagataca ggaatacaac aatcaaaact
12481 tactgaaact gtcaaaaaaa tagaaacata tatggtctat atatacacta caatttagtt
12541 attaattgga taaccgatgt gattatcaat caatattaag aaggttggta aattggtaca
12601 tagctaataa tacctataca cccaataata caacaaccat ttctgagttg gatatcatca
12661 aaatactgga taaatacgag gacgtgtata gagtaagtaa agaaaaagaa tgtgaaattt
12721 gctatgaagt tgtttactca aaacgataga tactttggtt tattggattc gtgtaatcat
12781 atatttgcca taacatgcat caatatatgg catagaacac gaagagaaac cggtgcgtcg
12841 gataattgtc ctatatgtcg tacccgtttt agaaacataa caatgagcaa gttaactaat
12901 aaataaaaag tttaatttgt tgacgacgta tgtcgttatt ttttctcgta taaaagatta
12961 atttgattct aatataatct ttagtattgg ataaatatca attcaaatta attccattag
13021 attatatcat aaataaaaat agtagcacgc actacttcag ccaaatattc ttttttgaaa
13081 cgccatctat cgtagtgagg acacaagtga acctataatg agcaaattta ttagtatcgg
13141 ttacatgaag gactttacgt agagtggtga ttccactatc tgtggtacga acggtttcat
13201 cttctttgat gccatcaccc agatgttcta taaacttggt atcctttgcc aaccaataca
13261 tatagctaaa ctcaggcata tgttccacac atcctgaaca atgaaattct ccagaagatg
13321 ttacaatgtc tagatttgga catttggttt caaccgcgtt aacatatgag tgaacacacc
13381 catacatgaa agcgatgaga aataggattt tcatcttgcc aaaatatcac tagaaaaaat
13441 ttatttatca atttaaaagg tataaaaaat acttattgtt gctcgaatat tttgtatttg
13501 atggtatacg gaagattaga aatgtaggta ttatcatcaa ctgattctat ggttttatgt
```

FIG. 22 (CONT.)

```
13561 attctatcat gtttcactat tgcgttggaa ataatatcat atgcttccac atatatttta
13621 ttttgtttta actcataata ctcacgtaat tctggattat tgacatatct atgaataatt
13681 ttagctccat gatcagtaaa tattaatgag aacatagtat taccacctac cattattttt
13741 ttcatctcat tcaattctta attgcaaaga tctatataat cattatagcg ttgacttatg
13801 gactctggaa tcttagacga tgtacagtca tctataatca tggcatattt aatacattgt
13861 tttatagcat agtcgttatc tacgatgtta gatatttctc tcaatgaatc aatcacacaa
13921 tctaatgtag gtttatgaca taatagcatt ttcagcagtt caatgttttt agattcgttg
13981 atggcaatgg ctatacatgt atatccgtta tttgatctaa tgttgacatc tgaaccggat
14041 tctagcagta aagatactag agattgttta ttatatctaa cagccttgtg aagaagtgtt
14101 tctcctcgtt tgtcaatcat gttaatgtct ttaagataag gtaggcaaat gtttatagta
14161 ctaagaattg ggcaagcata agacatgtca caaagaccct ttttgtatgt ataagtgtaa
14221 aaattataac attcatagtt ggatttacat aggtgtccaa tcgggatctc tccatcatcg
14281 agataattga tggcatctcc cttccttttt tagtagatat ttcatcgtgt aagaatcaat
14341 attaatattt ctaaagtatc cgtgtatagc ctctttattt accacagttc catattccac
14401 tagagggata tcgccgaatg tcatatactc aattagtata tgttggagga catccgagtt
14461 cattgttttc aatatcaaaa agatggtttc cttatcattt ctccatagtg gtacaatact
14521 acacattatt ccgtgcggct ttccattttc caaaaacaat ttgaccaaat ctacatcttt
14581 attgtatcta taatcactat ttagataatc agccataatt actcgagtgc aacatgttag
14641 atcgtctata tatgaataag ccgtgttatc tattcctttc attaacaatt taacgatgtc
14701 tatatctata tgagatgact taatataata ttgaagagct gtacaatagt ttttatctat
```

FIG. 22 (CONT.)

```
14761 aaaagacggc ttgattccgt gattaattag acatttaaca acttccggac gcacatatgc
14821 tctcgtatcc gactctgaat acagatgaga gatgatatac agatgcaata cggtaccgca
14881 atttcgtagt tgataatcat catacgcgta tcagtactcg tcctcataaa gaacactgca
14941 gccattttct atgaacaaat caataatttc aggaacagga tcatctgtca ttacataatt
15001 ttctataact gaacgatggt tttcacattt aacactcaag tcaaatccat gttctaccaa
15061 cacctttatc aagtcaacgt ctacattttt ggatttcata tagctgaata tattaaagtc
15121 atttatgttg ctaaatccag tggcttctag tagagccatc gctatatcct ttaactttaa
15181 catgtctact atttgtgtat tcttctaatg gggtagctgt ctccaatttt tgcgtaatgg
15241 attagtgcca ctgtctagta gtagtttgac gacctcgaca ttattacaat gctcattaaa
15301 aaggtatgcg tgtaaagcat tattcttgaa ttggttcctg gtatcattag gatctctgtc
15361 tctcaacatc tgtttaagtt catcgagagc cacctcctca ttttccaaat agtcaaacat
15421 tttgactgaa tgagctactg tgaactctat acacccacac aactaatgtc attaaatatc
15481 atgtcaaaaa cttgtacaat tattaataaa aataatttag tgtttaaatt ttaccagttc
15541 cagattttac acctccgtta accccacttt ttacaccact ggacgatcct cctccccaca
15601 ttccaccgcc accagatgta taagttttag atcctttatt actaccatca tgtccatgga
15661 taaagacact ccacatgccg ccactacccc ctttagaaga catattaata agacttaagg
15721 acaagtttaa caataaaatt aatcacgagt accctactac caacctacac tattatatga
15781 ttatagtttc tatttttaca gtaccttaac taaagtctct agtcacaaga gcaatactac
15841 caacctacac tattatatga ttatagtttc tatttttata ggaacgcgta cgagaaaatc
15901 aaatgtctaa tttctaacgg tagtgttgat aaacgattat cgtcaatgga tacctcctct
15961 atcatgtcgt ctattttctt actttgttct attaacttat tagcattata tattatttga
```

FIG. 22 (CONT.)

```
16021 ttataaaact tatattgctt attagcccaa tctgtaaata tcggattatt aacatatcgt
16081 ttctttgtag gtttatttaa catgtacatc actgtaagca tgtccgtacc atttatttta
16141 atttgacgca tatccgcaat ttctttttcg cagtcggtta taaattctat atatgatgga
16201 tacatgctac atgtgtactt ataatcgact aatatgaagt acttgataca tattttcagt
16261 aacgatttat tattaccacc tatgaataag tacctgtgat cgtctaggta atcaactgtt
16321 ttcttaatac attcgatggt tggtaattta ctcagaataa tttccaatat cttaatatat
16381 aattctgcta tttctgggat atatttatct gccagtataa cacaaatagt aatacatgta
16441 aacccatatt ttgttattat attaatgtct gcgccattat ctattaacca ttctactagg
16501 ctgacactat gcgacttaat acaatgataa agtatactac atccatgttt atatcatcaa
16561 tatacggctt acaaagtttt agtatcgata acacatccaa ctcacgcata gagaaggtag
16621 ggaataatgg cataatattt attaggttat catcattgtc attatctaca actaagtttc
16681 catttttaa aatatactcg acaactttag gatctctatt gccaaatttt tgaaaatatt
16741 tatttatatg cttaaatcta tataatgtag ctccttcatc aatcatacat ttaataacat
16801 tgatgtatac tgtatgataa gatacatatt ctaacaatag atcttgtata gaatctgtat
16861 atcttttaag aattgtggat attattacgt aaactattac acaattctaa aatataaaac
16921 gtatcacggt cgaataatag ttgatcaact atataattat cgatttgtg attttcttc
16981 ctaaactgtt tacgtaaata gttagataga atattcatta gttcatgacc actatagtta
17041 ctatcgaata acgcgtcaaa tatttcccgt ttaatatcgc atttgtcaag ataataatag
17101 agtgtggtat gttcacgata agtataataa cgcatctctt tttcgtgtga aattaaatag
17161 tttattacgt ccaaagatgt agcataacca tcttgtgacc tagtaataat ataataatag
17221 agaactgttt tacccattct atcatcataa tcagtggtgt agtcgtaatc gtaattgtct
```

FIG. 22 (CONT.)

```
17281 aattcatcat cccaattata atattcacca gcacgtctaa tctgttctat tttgatcttg
17341 tatccatact gtatgttgct acatgtaggt attcctttat ccaataatag tttaaacaca
17401 tctacattgg gatttgatgt tgtagcgtat ttttctacaa tattaatacc atttttgata
17461 ctatttattt ctataccttt cgaaattagt aatttcaata agtctatatc gatgttatca
17521 gaacatagat attcgagtat atcaaaatca ttgatatttt tatagtcgac tgacgacaat
17581 aacaaaatca caacatcgtt tttgatatta ttattttct tggtaacgta tgcctttaat
17641 ggagtttcac catcatactc atataatgga tttgcaccac tttctatcaa tgattgtgca
17701 ctgctggcat cgatgttaaa tgttttacaa ctatcataga gtatcttatc gttaaccatg
17761 attggttgtt gatgctatcg catttttgg tttctttcat ttcagttatg tatggattta
17821 gcacgtttgg gaagcatgag ctcatatgat ttcagtactg tagtgtcagt actattagtt
17881 tcaataagat caatctctag atctatagaa tcaaaacacg ataggtcaga agataatgaa
17941 tatctgtagg cttcttgttg tactgtaact tctcgttttg ttagatgttt gcatcgtgct
18001 ttaacatcaa tggtacaaat tttatcctcg ctttgtgtat catattcgtc cctactataa
18061 aattgtatat tcagattatc atgagatgtg tatacgctaa cggtatcaat aaacggagca
18121 caccatttag tcataaccgt aatccaaaaa tttttaaagt atatcttaac gaaagaagtt
18181 gtgtcattgt ctacggtgta tggtactaga tcctcataag tgtatatatc tagagtaatg
18241 tttaatttat caaatggttg ataatatgga tcctcatgac aatttccgaa gatggaaatg
18301 agatatagac atgcaataaa tctaattgcg gacatggtta ctccttaaaa aaatacgaat
18361 aatcaccttg gctatttagt aagtgtcatt taacactata ctcatattaa tccatggact
18421 cataatctct atacgggatt aacggatgtt ctatatacgg ggatgagtag ttttcttctt
```

FIG. 22 (CONT.)

```
18481 taactttata ctttttacta atcatattta gactgatgta tgggtaatag tgtttaaaga
18541 gttcgttctc atcatcagaa taaatcaata tctctgtttt tttgttatac agatgtatta
18601 cagcctcata tattacgtaa tagaacgtgt catctacctt attaactttc accgcatagt
18661 tgtttgcaaa tacggttaat cctttgacct cgtcgatttc cgaccaatct gggcgtataa
18721 tgaatctaaa ctttaatttc ttgtaatcat tcgaaataat ttttagtttg catccgtagt
18781 tatccccttt atgtaactgt aaatttctca acgcgatatc tccattaata atgatgtcga
18841 attcgtgctg tatacccata ctgaatggat gaacgaatac cgacggcgtt aatagtaatt
18901 tactttttca tctttacata ttgggtacta gttttactat cataagttta taaattccac
18961 aagctactat ggaataagcc aaccatctta gtataacaca catgtcttaa agtttattaa
19021 ttaattacat gttgttttat atatcgctac gaatttaaac agagaaatca gtttaggaaa
19081 aaaaaatatc tatctacatc atcacgtctc tgtattctac gatagagtgc tactttaaga
19141 tgagacatat ccgtgtcatc aaaaatatac tccattaaaa tgattattcc ggcagcgaac
19201 ttgatattgg atatatcaca acctttgtta atatctacga caatagacag cagtcccatg
19261 gttccataaa cagtgagttt atctttcttt gaagagatat tttgtagaga tcttataaaa
19321 ctgtcgaatg acatcgcatt tatatcttta gctaaatcgt atatgttacc atcgtaatat
19381 ctaaccgcgt ctatcttaaa cgtttccatc gctttaaaga cgtttccgat agatggtctc
19441 atttcatcag tcatactgag ccaacaaata taatcgtgta taacatcttt gatagaatca
19501 gactctaaag aaaacgaatc ggctttatta tacgcattca tgataaactt aatgaaaaat
19561 gtttttcgtt gtttaagttg gatgaatagt atgtcttaat aattgttatt atttcattaa
19621 ttaatattta gtaacgagta cactctataa aaacgagaat gacataacta gttatcaaag
19681 tgtctaggac gcgtaatttt catatggtat agatcctgta agcattgtct gtattctgga
```

FIG. 22 (CONT.)

```
19741 gctattttct ctatatctaa tttctgaacg ttcaccaatg tctctagcca ctttggcact
19801 aatagcgatc attcgcttag cgtcttctat attattaact ggttgattca atctatctag
19861 caatggaccg tcggacagcg tcattctcat gttcttaatc aatgtacata catcgccgtc
19921 atctaccaat tcatccaaca acataagctt tttaaaatca tcattataat aggtttgatc
19981 gttgtcattt ctccaaagaa tatatctaat aagtagagtc ctcatgatta gttaacaact
20041 attttttatg ttaaatcaat tagtacaccg ctatgtttaa tacttattca tattttagtt
20101 tttaggattg agaatcaata caaaaattaa tgcatcatta attttagaaa tacttagttt
20161 ccacgtagtc aatgaaacat ttgaactcat cgtacaggac gttctcgtac aggacgtaac
20221 tataaaccgg tttatatttg ttcaagatag atacaaatcc gataactttt tttacgaatt
20281 ctacgggatc cactttaaaa gtgtcatacc gggttctttt tattttttta aacagattaa
20341 tggtgtgatg ttgattaggt cttttacgaa tttgatatag aatagcgttt acatattctc
20401 cataatggtc aatcgccatt tgttcgtatg tcataaattc tttaattata tgacactgtg
20461 tattatttag ttcatccttg ttcatcatta ggaatctatc caatatggca attatactag
20521 aactataggt gcgttgtata cacatattga tgtgtctgtt tatacaatcc atgctactac
20581 cttcgggtaa aattgtagca tcatatacca tttctagtac tttaggttca ttgttatcca
20641 ttgcagagga cgtcatgatc gcatcctaaa aaaatatatt atttttatgt tattttgtta
20701 aaaataatca tcgaatacga atcatccagt ccactgaata gcaaaatctt tactattttg
20761 gtatcttcca atgtggctgc ctgatgtaat ggaaattcat tctctagaag atttttcaat
20821 gctccagcgt tcaacaacgt acatactaga cgcacgttat tatcagctat tgcataatac
20881 aaggcactat gtccatggac atccgcctta aatgcatctt tgctagagag aaagcttttc
20941 agctgcttag acttccaagt attaattcgt gacagatcca tgtctgaaac gagacgctaa
```

FIG. 22 (CONT.)

```
21001 ttagtgtata atttttgtca tattgcacca gaattaataa tatctctaat agatctgatt
21061 agtagataca tggctatcgc aaaacaacat atacacattt aataaaaata atatttatta
21121 agaaaattca gatttcacgt acccatcaat ataaataaaa taatgattcc ttacaccgta
21181 cccatattaa ggagattcta ccttacccat aaacaatata aatccagtaa tatcatgtct
21241 gatgatgaac acaaatggtg tattaaattc cagtttttca ggagatgatc tcgccgtagc
21301 taccataata gtagatgcct ctgctacagt tccttgttcg tcgacatcta tctttgcatt
21361 ctgaaacatt ttataaatat ataatgggtc cctagtcata tgtttaaacg acgcattatc
21421 tggattaaac atactaggag ccatcatttc ggctatcgac ttaatatccc tcttattttc
21481 gatagaaaat ttagggagtt taagattgta cactttattc cctaattgaa acgaccaata
21541 gtctaatttt gcagccgtaa tagaatctgt gaaatgggtc atattatcac ctattgccag
21601 gtacatacta atattagcat ccttatacgg aaggcgtacc atgtcatatt ctttgtcatc
21661 gattgtgatt gtatttcctt gcaatttagt aactacgttc atcatgggaa ccgttttcgt
21721 accgtactta ttagtaaaac tagcattgcg tgttttagtg atatcaaacg gatattgcca
21781 tataccttta aaatatatag tattaatgat tgcccataga gtattattgt cgagcatatt
21841 agaatctact acattagaca taccggatct acgttctact atagaattaa ttttattaac
21901 cgcatctcgt ctaaagttta atctatatag gccgaatcta tgatattgtt gataatacga
21961 cggtttaata cacacagtat tatctacgaa actttgataa gttagatcag tgtacgtata
22021 tttagatgtt ttcagcttag ctaatcctga tattaattct gtaaatgctg gacccagatc
22081 tctttttctc aaatccatag tcttcaataa ttctattcta gtattacctg atgcaggcaa
22141 tagcgacata aacatagaaa acgaataacc aaacggtgag aagacaatat tatcatcttg
```

FIG. 22 (CONT.)

```
22201 aatattttta tacgctacta taccggcatt ggtaaatcct tgtagacgat aggtagacgc
22261 tgaacacgtt aacgatagta tcaataacgc aatcatgatt ttatggtatt aataattaac
22321 cttattttta tgttcggtat aaaaattatt gatgtctaca catccttttg taattgacat
22381 ctatatatcc ttttgtataa tcaactctaa tcactttaac ttttacagtt ttccctacca
22441 gtttatccct atattcaaca tatctatcca tatgcatctt aacactctct gccaagatag
22501 cttcagagtg aggatagtca aaaagataaa tatatagagc ataatcattc tcgtatactc
22561 tgccctttat tacatcgccc gcattgggca acgaataaca aaatgcaagc atcttgttaa
22621 cgggctcgta aattgggata aaaattatgt ttttatatct attttattca agagaatatt
22681 caggaatttc tttttccggt tgtatctcat cgcagtatat atcatttgta cattgtttca
22741 tatttttttaa tagtttacac cttttagtag gactagtatc gtacaattca tagctgtatt
22801 ttgaattcca atcacgcata aaaatatctt ctaattgttg acgaagacct aatccatcat
22861 ccggtgtaat attaatagat gctccacatg tatccgtaaa gtaatttcct gtccaatttg
22921 aggtacctat ataggccgtt ttatcggtta ccatatattt ggcatggttt accctagaat
22981 acggaatggg aggatcagca tctggtacaa taaatagctt tacttctata tttatgtttt
23041 tagattttag catagcgata gatcttaaaa agtttctcat gataaacgaa gatcgttgcc
23101 agcaactaat caatagctta acggatactt gtctgtctat agcggatctt cttaattcat
23161 cttctatata aggccaaaac aaaattttac ccgccttcga ataaataata gggataaagt
23221 tcataacaga tacataaacg aatttactcg catttctaat acatgacaat aaagcggtta
23281 aatcattggt tctttccata gtacatagtt gttgcggtgc agaagcaata aatacagagt
23341 gtggaacacc acttacgtta atactaagag gatgatctgt attataatac gacggataaa
23401 agtttttcca attatatggt agattgttaa ctccaagata ccagtatacc tcaaaaattt
```

FIG. 22 (CONT.)

```
23461 gagtgagatc cgctgccaag ttcctattat tgaagatcgc aatacccaat tctttgacct
23521 gagttagtga tctccaatcc atgttagcgc ttcctaaata aatatgtgta ttatcagata
23581 tccaaaattt tgtatgaaga actcctccta ggatatttgt aatatctatg tatcgtactt
23641 caactccggc catttgtagt ctttcaacat cctttaatgg tttgttagat ttattgacgg
23701 ctactctaac tcgtactcct cttttgggta attgtacaat ctcgtttaat attatcgtgc
23761 cgaaattcgt acccacttca tccgataaac tccaataaaa agatgatata tctagtgttt
23821 ttgtggtatt ggatagaatt tccctccaca tgttaaatgt agacaaatat actttatcaa
23881 attgcatacc tataggaata gtctctgtaa tcactgcgat tgtattatcc ggattcattt
23941 tatttgttaa aagaataatc ctatatcact tcactctatt aaaaatccaa gtttctattt
24001 ctttcatgac tgattttta acttcatccg tttccttatg aagatgatgt ttggcacctt
24061 cataaatttt tatttctcta ttacaatttg catgttgcat gaaataatat gcacctaaaa
24121 catcgctaat ctcattgttt gttccctgga gtatgagagt cggggtgtta atcttggaaa
24181 ttatttttct aaccttgttg gtagccttca agacctgact agcaaatcca gccttaattt
24241 tttcatgatt gattaatggg tcgtattggt atttataaac tttatccata tctctagata
24301 ctgattctgg acatagcttt ccgactggcg catttggtgt gatggttccc ataagtttgg
24361 cagctagcag attcagtctt gaaacagcat ctgcattaac tagaggagac attagaatca
24421 ttgctgtaaa caagtttgga ttatcgtaag aggctagtat agaaattgtt gctcccatgg
24481 aatgacccaa taagtagatt taatagttac cacgtgctgt accaaagtca tcaatcatca
24541 tttttcacc attacttctt ccatgtccaa tatgatcatg tgagaatact aaaattccta
24601 acgatgatat gttttcagct agttcgtcat aacgtccaga atgtttacca gctccatgac
24661 ttatgaatac taatgcctta ggatatgtaa tcattgtcca gattgaacat acagtttgca
```

FIG. 22 (CONT.)

```
24721 ctcatgattc acgttatata actatcaata ttaacagttc gtttgatgat catattattt
24781 ttatgtttta ttgataattg taaaaacata caattaaatc aatatagagg aaggagacgg
24841 ctactgtctt ttgtgagata gtcatggcga ctaaattaga ttatgaggat gctgtttttt
24901 actttgtgga tgatgataaa atatgtagtc gcgactccat catcgatcta atagatgaat
24961 atattacgtg gagaaatcat gttatagtgt ttaacaaaga tattaccagt tgtggaagac
25021 tgtacaagga attgatgaag ttcgatgatg tcgctatacg gtactatggt attgataaaa
25081 ttaatgagat tgtcgaagct atgagcgaag gagaccacta catcaatttt acaaaagtcc
25141 atgatcagga aagtttattc gctaccatag gaatatgtgc taaaatcact gaacattggg
25201 gatacaaaaa gatttcagaa tctagattcc aatcattggg aaacattaca gatctgatga
25261 ccgacgataa tataaacatc ttgatacttt ttctagaaaa aaaattgaat tgatgatata
25321 ggggtcttca taacgcataa ttattacgtt agcattctat atccgtgtta aaaaaaatta
25381 tcctatcatg tatttgagag ttttatatgt agcaaacatg atagctgtga tgccaataag
25441 ctttagatat tcacgcgtgc tagtgttagg gatggtatta tctggtggtg aaatgtccgt
25501 tatataatct acaaaacaat catcgcatat agtatgcgat agtagagtaa acatttttat
25561 agtttttact ggattcatac atcgtctacc caattcggtt atgaatgaaa ttgtcgccaa
25621 tcttacaccc aaccccttgt tatccattag tatagtatta acttcgttat ttatgtcata
25681 aactgtaaat gattttgtag atgccatatc atacatgata ttcatgtccc tattataatc
25741 attactaact ttatcacaat atatgttgat aatatctata tatgatctag tctttgtggg
25801 caactgtcta tacaagtcgt ctaaacgttg tttactcata tagtatcgaa cagccatcat
25861 tacatggtcc cgttccgttg atagataatc gagtatgtta gtggacttgt caaatctata
```

FIG. 22 (CONT.)

```
25921 taccatattt tctggaagtg gatatacata gtcgtgatca acattattgc tagcctcatc
25981 ttctatatcc tgtactatac catctacata atctacgata ttattacaca taaacatcga
26041 caacatacta ttgtttatta tctaagtcct gttgatccaa acccttgatc tcctctattt
26101 gtactatcta gagattgtac ttcttccagt tctggataat atatacgttg atagattagc
26161 tgagctattc tatctccagt atttacatta aacgtacatt ttccattatt aataagaatg
26221 actcctatgt ttcccctata atcttcgtct attacaccac ctcctatatc aatgcctttt
26281 agtgacagac cagacctagg agctattcta ccatagcaaa tcttaggcat ggacatacta
26341 atatctgtct taattaactg tctttctcct ggagggatag tataatcgta agcgctatac
26401 aaatcatatc cggcagcacc cggcgattgc ctagtaggag atttagctct gttagtttcc
26461 ttaacaaatc taactggtga gttaatattc atgttgaaca taaaactaat attttatttc
26521 aaaattattt accatcccat atattccatg aataagtgtg atgattgtac acttctatag
26581 tatctatata cgattcacga taaaatcctc ctatcaatag cagtttatta tccactatga
26641 tcaattctgg attatccctc ggataaatag gatcatctat cagagtccat gtattgctgg
26701 attcacaata aaattccgca tttctaccaa ccaagaataa ccttctaccg aacactaacg
26761 cgcatgattt ataatgagga taataagtgg atggtccaaa ctgccactga tcatgattgg
26821 gtagcaaata ttctgtagtt gtatcagttt cagaatgtcc tcccattacg tatataacat
26881 tgtttatgga tgccactgct ggattacatc taggtttcag aagactcggc atattaaccc
26941 aagcagcatc cccgtggaac caacgctcaa cagatgtggg atttggtaga cctcctacta
27001 cgtataattt attgttagcg ggtatcccgc tagcatacag tctggggcta ttcatcggag
27061 gaattggaat ccaattgttt gatatataat ttacagctat agcattgtta tgtatttcat
27121 tgttcatcca tccaccgatg agatatacta cttctccaac atgagtactt gtacacatat
```

FIG. 22 (CONT.)

```
27181 ggaatatatc tataatttga tccatgttca taggatactc tatgaatgga tacttgtatg
27241 atttgcgtgg ttgtttatca caatgaaata ttttggtaca gtctagtatc cattttacat
27301 tatttatacc tctgggagaa agataatttg acctgattac atttttgata aggagtagca
27361 gatttcctaa tttatttctt cgctttatat accacttaat gacaaaatcc tcatctggaa
27421 catttagttc atcgctttct agaataagtt tcatagatag ataatcaaaa ttgtctatga
27481 tgtcatcttc cagttccaaa aagtgtttgg caataaagtt tttagtatga cataagagat
27541 tggatagtcc gtattctata cccatcatgt aacactcgac acaatattcc tttctaaaat
27601 ctcgtaggat aaagtttata caagtgtaga tgataaattc tacagaggtt aatatagaag
27661 cacgtaataa attgacgacg ttatgactat ctatatatac ctttccagta tatgagtaaa
27721 taactataga agttagactg tgaatgtcaa ggtctagaca aaccctcgta actggatctt
27781 tatttttcgt gtatttttga cgtaaatgtg tgcgaaagta aggagataac tttttcaata
27841 tcgtagaatt gactattata ttgcctccta tggcatcaat aattgttttg aatttcttag
27901 tcatagacaa tgctaatata ttcttacagt acacagtatt gacaaatatc ggcatttatg
27961 tttctttaaa agtcaacatc taaagaaaaa tgattatctt cttgagacat aactcccatt
28021 ttttggtatt cacccacacg tttttcgaaa aaattagttt taccttctaa tgatatattt
28081 tccatgaaat caaacggatt ggtaacatta taaatttttt taaatcccaa ttcagaaatc
28141 aatctatccg cgacgaattc tatatatgtt ttcatcattt cacaattcat tcctataagt
28201 ttaactggaa gagccgcagt aagaaattct tgttcaatgg ataccgcatc tgttataata
28261 gatctaacgg tttcttcact cggtggatgc aataaatgtt taaacatcaa acatgcgaag
28321 tcgcagtgta gaccctcgtc tctactaatc aattcgttgg aaaacgtgag tccgggcatt
28381 aggccacgct ttttaagcca aaatatggaa gcgaatgatc cggaaaagaa gattccttct
```

FIG. 22 (CONT.)

```
28441 actgcagcaa aggcaataag tctctctcca taaccggcgc tgtcatgtat ccacttttga
28501 gcccaatcgg ccttcttttt tacacaaggc atcgtttcta tggcattaaa gagatagttt
28561 ttttcattac tatctttaac ataagtatcg atcaaaagac tatacatttc cgaatgaatg
28621 ttttcaatgg ccatctgaaa tccgtagaaa catctagcct cggtaatctg tacttctgta
28681 caaaatcgtt ccgccaaatt ttcattcact attccgtcac tggctgcaaa aaacgccaat
28741 acatgtttta taaaatattt ttcgtctggt gttagtttat tccaatcatt gatatcttta
28801 gatatatcta cttcttccac tgtccaaaat gatgcctctg cctttttata catgttccag
28861 atgtcatgat attggattgg gaaaataaca aatctatttg gatttggtgc aaggatgggt
28921 tccataacta aattaacaat aacaataaat tttttttcag ttatctatat gcctgtactt
28981 ggatcttttg tacatcgata tcgccgcaat cactacaata attacaagta ttattgatag
29041 cattgttatt agtactatca taattaaatt atcgttatta tcattttgta attgtgacat
29101 catactagat aaatcgtttg cgagattgtt gtgggaagcg ggcatggagg atgaattatc
29161 gttattatta tttaaagcct cccattcgga ttcacaaata tggcgcgcgt tcaacatttt
29221 atggaaacag ataacaagaa aactcgtcat cgttcaaatt tttaacgata gtaaaccgat
29281 taaacgtcga gctaatttct aacgctagcg actctgttgg atatgggttt ccagatatat
29341 atcttttcag ttcccctacg tatctataat catctgtagg aaatggaaga tatttccatt
29401 tatctactgt tcctaatatc atatgtggtg gtgtagtaga accattaagc gcgaaagatg
29461 ttatttcgca tcgtatttta acttcgcaat aatttctggt tagataacgc actctaccag
29521 tcaagtcaat gatattagcc tttacagata tattcatagt agtcgtaacg atgactccat
29581 cttttagatg cgatactcct ttgtatgtac cagaatcttc gtacctcaaa ctcgatatat
```

FIG. 22 (CONT.)

```
29641 ttaaacaagt taatgagata ttaacgcgtt ttatgaatga tgatatataa ccagaagttt
29701 tatcctcggt ggctagcgct ataaccttat cattataata ccaactagtg tgattaatat
29761 gtgacacgtt agtgtgggta caaatatgta cattatcgtc tacgtcgtat tcgatacatc
29821 cgcatacagc caacaaatat aaaatgacaa atactctaac gccgttcgta cccatcttga
29881 tgcggtttaa taaatgtttt gatttcaatt tattgtaaaa aaagattcgg ttttatactg
29941 ttcgatattc tcattgctta tattttcatc tatcatctcc acacagtcaa atccgtggtt
30001 agcatgcacc tcatcaaccg gtaaaagact atcggactct tctatcatta taactctaga
30061 atatttaatt tggtcattat taatcaagtc aattatctta tttttaacaa acgtgagtat
30121 tttactcatt ttttataaaa acttttagaa atatacagac tctatcgtgt gtctatatct
30181 tctttttata tccaatgtat ttatgtctga tttttcttca tttatcatat ataatggtcc
30241 aaattctaca cgtgcttcgg attcatccag atcattaagg ttcttataat tgtaacatcc
30301 ttctcttccc tcttctacat cttccttctt attcttattc ttagcgtcac agaatctacc
30361 acagcaggat cccatgacga gcgtcatatt aaactaatcc attttcaatt ataatatacg
30421 attagtaatg accattaaaa taaaaatatt cttcataacc ggcaagaaag tgaaaagttc
30481 acattgaaac tatgtcagta gtatacatca tgaaatgatg atatatatat actctatttt
30541 ggtggaggat tatatgatat aattcgtgga taatcattct taagacacat ttcttcattc
30601 gtaaatcttt tcacgttaaa tgagtgtcca tattttgcaa tttcttcata tgatggcggt
30661 gtacgtggac gaggctgctc ctgttcttgt tgtagtcgcc gactgtcgtg tctgcgttta
30721 gatccctcca ttatcgcgat tgcgtagatg gagtactatt ttataccttg taattaaatt
30781 tttttattaa ttaaacgtat aaaaacgttc cgtatctgta tttaagagcc agatttcgtc
30841 taatagaaca aatagctaca gtaaaaataa ctagaataat tgctacaccc actagaaacc
```

FIG. 22 (CONT.)

```
30901 acggatcgta atacggcaat cggttttcga taataggtgg aacgtatatt ttatttaagg
30961 acttaacaat tgtctgtaaa ccacaatttg cttccgcgga tcctgtatta actatctgta
31021 aaagcatatg ttgaccgggc ggagccgaac attctccgat atccaatttc tgtatatcta
31081 taatattatt aacctccgca tacgcattac agttcttttc tagcttggat accgcactag
31141 gtacatcgtc tagatctatt cctatttcct cagcgatagc tcttctatcc ttttccggaa
31201 gcaatgaaat cacttcaata aatgattcaa ccatgagtgt gaaactaagt cgagaattac
31261 tcatgcattt gttagttatt cggagcgcgc aatttttaaa ctgtcctata acctctccta
31321 tatgaatagc acaagtgaca ttagtaggga tagaatgttg agctaatttt tgtaaataac
31381 tatctataaa aagattatac aaagttttaa actctttagt ttccgccatt tatccagtct
31441 gagaaaatgt ctctcataat aaatttttcc aagaaactaa ttgggtgaag aatggaaacc
31501 tttaatctat atttatcaca gtctgttttg gtacacatga tgaattcttc caatgccgta
31561 ctaaattcga tatctttttc gatttctgga tatgttttta ataaagtatg aacaaagaaa
31621 tggaaatcgt aataccagtt atgtttaact ttgaaattgt tttttatttt cttgttaatg
31681 attccagcca cttgggaaaa gtcaaagtcg tttaatgccg atttaatacg ttcattaaaa
31741 acaaactttt tatcctttag atgaattatt attggttcat tggaatcaaa aagtaagata
31801 ttatcgggtt taagatctgc gtgtaaaaag ttgtcgcagc atggtagttc gtaaatttta
31861 atgtataaca gagccatctg taaaaagata aactttatgt attgtaccaa agatttaaat
31921 cctaatttga tagctagctc ggtatctact ttatctgccg aatacagtgc taggggaaaa
31981 attataatat ttcctctttc gtattcgtag ttagttctct tttcatgttc gaaaaagtga
32041 aacatgcggt taaaatagtt tataacatta atattactgt taataactgc cggataaaag
32101 tgggatagta atttcacgaa tttgatactg tcctttctct cgttaaacgc ctttaaaaaa
```

FIG. 22 (CONT.)

```
32161 actttagaag aatatctcaa tgatagttcc tgaccatcca tagtttgtat caataatagc
32221 aacatatgaa gaacacgttt atacagagta tgtaaaaatg ttaatttata gtttaatccc
32281 atggcccacg cacacacgat taattttttt tcatctccct ttagattgtt gtatagaaat
32341 ttgggtactg tgaactccgc cgtagtttcc atgggactat ataattttgt ggcctcgaat
32401 acaaatttta ctacatagtt atctatctta aagactatac catatcctcc tgtagatatg
32461 tgataaaaat cgtcgtttat aggataaaat cgtttatcct tttgttggaa aaaggatgaa
32521 ttaatgtaat cattctcttc tatctttagt agtgtttcct tattaaaatt cttaaaataa
32581 tttaacaatc taactgatgg agcccaattt tggtgtaaat ctaattggga cattatattg
32641 ttaaaataca aacagtctcc taatataaca gtatctgata atctatgggg agacatccat
32701 tgatattcag gggatgaatc attggcaaca cccatttatt gtacaaaaag ccccaattta
32761 caaacgaaag tccaggtttg atagagacaa actattaact atttgtctc tgtttttaat
32821 ttctttggta atgaaattat tcacaatatc agtatcttct ttatctacca gagattttac
32881 taacttgata accttggctg tctcattcaa tagggtagta atatttgtat gtgtgatatt
32941 gatatctttt agaagtgatt ctttgatggt gccagcatac gaattacaat aatgcagaaa
33001 ctcggttaac atgcaggaat tatagtaagc caattccaat tgttgcctgt gttgtattag
33061 agtgtcaata tgagcaatgg tgtccttgcg tttctctgat agaatgcgag cagcgatttt
33121 ggcgttatca tttgacgata tttctggaat gacgaatcct gtttctacta actttttggt
33181 aggacaaagt gaaacaatca agaagatagc ttctcctcct atttgtggaa gaaattgaac
33241 tcctctagat gatctccttg acagatattg gaccgaatta cagaagtacc tggaatgtaa
33301 agccctgaaa ccccctcatt ttttaagcag attgttgccg taaatcctgc actatgccca
```

FIG. 22 (CONT.)

```
33361 agatagagag ctcctttggt gaatccatct ctatgtttca gtttaaccaa gaaacagtca
33421 gctggtctaa aatttccatc tctatctaat acagcatcta acttgatgtc aggaactatg
33481 accggttatg ttatatgtaa cattgagtaa atccttaagt tcataatcat cactgtcatc
33541 agttatgtac gatccaaaca atgtttctac tggcatagtg gatacgaaga tgctatccat
33601 cagaatgttt ccctgattag tattttctat atagctattc ttctttaaac gattttccaa
33661 atcagtaact atgttcattt ttttaggagt aggacgccta gccagtatgg aagaggattt
33721 tctagatcct ctcttcaaca tctttgatct caatggaatg caaaacccca tagtgtaaca
33781 accaacgata aaaataatat tgtttttcac tttttataat tttaccatct gactcatgga
33841 ttcattaata tctttataag agctactaac gtataattct ttataactga actgagatat
33901 atacaccgga tctatggttt ccataattga gtaaatgaat gctcggcaat aactaatggc
33961 aaatgtataa aacaacgaaa ttatactaga gttgttaaag ttaatatttt ctatgagctg
34021 ttccaataaa ttatttgttg taactgcgtt caagtcataa atcatcttga tactatccag
34081 taaaccgttt ttaagttctg gaatattatt atcccattgt aaagccccta attcgactat
34141 cgaatatcct gctctgatag cagtttcaat atcgacggac gtcaatactg taataaaggt
34201 ggtagtattg tcatcatcgt gataaactac tggaatatgg tcgttagtag gtacggtaac
34261 tttacacaac gcgatatata actttccttt tgtaccattt ttaacgtagt tgggacgtcc
34321 tgcagggtat tgttttgaag aaatgatatc gagaacagat ttgatacgat atttgttgga
34381 ttcctgatta tttactataa tataatctag acagatagat gattcgataa atagagaagg
34441 tatatcgttg gtaggataat acatccccat tccagtattc tcggatactc tattaatgac
34501 actagttaag aacatgtctt ctattctaga aaacgaaaac atcctacatg gactcattaa
34561 aacttctaac gctcctgatt gtgtctcgaa tgcctcgtac aaggatttca aggatgccat
```

FIG. 22 (CONT.)

```
34621 agattctttg accaacgatt tagaattgcg tttagcatct gattttttta ttaaatcgaa
34681 tggtcggctc tctggtttgc taccccaatg ataacaatag tcttgtaaag ataaaccgca
34741 agaaaattta tacgcatcca tccaaataac cctagcacca tcggatgata ttaatgtatt
34801 attatagatt ttccatccac agttattggg ccagtatact gttagcaacg gtatatcgaa
34861 tagattactc atgtaaccta ctagaatgat agttcgtgta ctagtcataa tatctttaat
34921 ccaatctaag aaatttaaaa ttagattttt tacactgtta aagttaacaa aggtattacc
34981 cggatacgtg gatatcatat atggtattgg tccattatca gtaatagctc cataaactga
35041 tacggcgatg gtttttatat gtgtttgatc taacgaggaa gaaattcgcg cccacaattc
35101 atctctagat atgtatttaa tatcaaacgg taacacatca atttcgggac gcgtatatgt
35161 ttctaaattt ttaatccaaa tataatgatg acctatatgc cctattatca tactgtcaac
35221 tatagtacac ctagagaact tacgatacat ctgtttccta taatcgttaa attttacaaa
35281 tctataacat gctaaacctt ttgacgacaa ccattcatta atttctgata tggaatctgt
35341 attctcaata ccgtatcgtt ctaaagccag tgctatatct ccctgttcgt gagaacgctt
35401 tcgtataata tcgatcaacg gataatctga agtttttgga gaataatatg actcatgatc
35461 tatttcgtcc ataaacaatc tagacatagg aattggaggc gatgatctta attttgtgca
35521 atgagtcgtc aatcctataa cttctaatat tgtaatattc atcatcgaca taacactatc
35581 tatgttatca tcgtatatta gtataccatg accttcttca tttcgtgcca aaatgatata
35641 cagtcttaaa tagttacgca atatctcaat agtttcataa ttgttagctg ttttcatcaa
35701 ggtttgtatc ctgtttaaca tgatggcgtt ctatacgttt ctatttttta aatttttaac
35761 gatttactgt ggctagatac ccaatctctc tcaaatattt ttttagcctc gcttacaagc
35821 tgtttatcta tactattaaa actgacgaat ccgtgatttt ggtaatgggt tccgtcgaaa
```

FIG. 22 (CONT.)

```
35881 tttgccgaag tgatatgaac atattcgtcg tcgactatca acaattttgt attattctga
35941 atagtgaaaa ccttcacaga tagatcattt tgaacacaca acgcgtctag acttctggcg
36001 gttgccatag aatatacgtc gttcttatcc caattaccaa ctagaagtct gatcttaact
36061 cctctattaa tggctgcttc tataatggag ttgtaaatgt cgggccaata gtagctatta
36121 ccgtcgacac gtgtagtggg aactatggcc aaatgttcaa tatctatact agtcttagcc
36181 gacttgagtt tatcaataac tacatcagtg tctagatctc tagaatatcc caataggtgt
36241 tccggagaat cagtaaagaa cactccacct ataggattct taatatgata cgcagtgcta
36301 actggcagac aacaagccgc agagcataaa ttcaaccatg aatttttgc gctattaaag
36361 gctttaaaag tatcaaatct tctacgaaga tctgtggcca gcgggggata atcagaatat
36421 acacctaacg ttttaatcgt atgtatagat cctccagtaa atgacgcgtt tcctacataa
36481 catctttcat tatctgacac ccaaaaacaa ccgagtagta gtcccacatt atttttttta
36541 tctatattaa cggttataaa atttatatcc gggcagtgac tttgtagctc tcccagattt
36601 cttttccctc gttcatctag caaaactatt attttaatcc ctttttcaga tgcctctttt
36661 agtttatcaa aaataagcgc tcccctagtc gtactcagag gattacaaca aaaagatgct
36721 atgtatatat atttcttagc tagagtgata atttcgttaa aacattcaaa tgttgttaaa
36781 tgatcggatc taaaatccat attttctggt agtgtttcta ccagcctaca ttttgctccc
36841 gcaggtaccg gtgcaaatgg ccacatttag ttaacataaa aacttataca tcctgttcta
36901 tcaacgattc tagaatatca tcggctatat cgctaaaatt ttcatcaaag tcgacatcac
36961 aacctaactc agtcaatata ttaagaagtt ccatgatgtc atcttcgtct atttctatat
37021 ccgtatccat tgtagattgt tgaccgatta tcgagtttaa atcattacta atactcaatc
```

FIG. 22 (CONT.)

```
37081 cttcagaata caatctgtgt ttcattgtaa atttataggc ggtgtattta agttggtaga
37141 ttttcaatta tgtatcaata tagcaacagt agttcttgct cctccttgat tctagcatcc
37201 tcttcattat tttcttctac gtacataaac atgtccaata cgttagacaa cacaccgacg
37261 atggcggccg ccacagacac gaatatgact aaaccgatga ccatttaaaa acccctctct
37321 agctttcact taaactgtat cgattattct tttagaacat gtataatata aaaacattat
37381 tctatttcga atttaggctt ccaaaaattt ttcatccgta aaccgataat aatatatata
37441 gacttgttaa tagtcggaat aaatagatta atgcttaaac tatcatcatc tccacgatta
37501 gagatacaat atttacattt tttttgctgt ttcgaaactt tatcaataca cgttaataca
37561 aacccaggaa ggagatattg aaactgaggc tgttgaaaat gaaacggtga atacaataat
37621 tcagataatg taaaatcatg attccgtatt ctgatgatat tagaactgct aatggatgtc
37681 gatggtatgt atctaggagt atctatttta acaaagcatc gatttgctaa tatacaatta
37741 tcattttgat taattgttat tttattcata ttcttaaaag gtttcatatt tatcaattct
37801 tctacattaa aaatttccat ttttaattta tgtagccccg caatactcct cattacgttt
37861 catttttgt ctataatatc cattttgttc atctcggtac atagattatc caattgagaa
37921 gcgcatttag tagttttgta cattttaagt ttattgacga atcgtcgaaa actagttata
37981 gttaacattt tattatttga taccctgata ttaatacccc tgccgttact attatttata
38041 actgatgtaa tccacgtaac attggaatta actatcgata gtaatgcatc gacgcttcca
38101 aaattgtcta ttataaactc accgataatt tttttattac atgttttcat attcattagg
38161 attattaaat ctttaatctt actacgattg tatgcgttga tattgcaaga cgtcattcta
38221 aaagacggag gatctccatc aaatgccaga caatcacgta caaagtacat ggaaataggt
38281 tttgttctat tgcgcatcat agatttatat agaacacccg tagaaatact aatttgtttt
```

FIG. 22 (CONT.)

```
38341 actctataaa atactaatgc atctatttca tcgttttgta taacgtcttt ccaagtgtca
38401 aattccaaat tttttcatt gatagtacca aattcttcta tctctttaac tacttgcata
38461 gataggtaat tacagtgatg cctacatgcc gtttttgaa actgaataga tgcgtctaga
38521 agcgatgcta cgctagtcac aatcaccact ttcatattta gaatatatat atgtaaaaat
38581 atagtagaat ttcattttgt tttttttcta tgctataaat gaattctcat tttgcatctg
38641 ctcatactcc gttttatatc aataccaaag aaggaagata tctggttcta aaagccgtta
38701 aagtatgcga tgttagaact gtagaatgcg aaggaagtaa agcttcctgc gtactcaaag
38761 tagataaacc ctcatcaccc gcgtgtgaga gaagaccttc gtccccttcc agatgcgaga
38821 gaatgaataa cccaggaaaa caagttccgt ttatgaggac ggacatgcta caaaatatgt
38881 tcgcggctaa tcgcgataat gtagcttcta gacttttgtc ctaaaataca attatatcct
38941 tttcgatatt aataaatccg tgtcgtccag gtttttatc tctttcagta tgtgaataga
39001 taggtatttt atctctattc atcatcgaat ttaagagatc cgataaacat tgtttgtatt
39061 ctccagatgt cagcatctga tacaacaata tatgtgcaca taaacctctg gcacttattt
39121 catgtacctt cccccttatca ctaaggagaa tagtatttga gaaatatgta tacatgatat
39181 tatcatgaat tagatataca gaatttgtaa cactctcgaa atcacacgat gtgtcggcgt
39241 taagatctaa tatatcactc gataacacat tttcatctag atacactaga catttttaa
39301 agctaaaata gtctttagta gtaacagtaa ctatgcgatt attttcatcg atgatacatt
39361 tcatcggcat attattacgc ttaccatcaa agactatacc atgtgtatat ctaacgtatt
39421 ctagcatggt tgccatacgc gcattaaact tttcaggatc tttggataga tcttccaatc
39481 tatctatttg agaaaacatt tttatcatgt tcaatagttg aaacgtcgga tccactatat
39541 agatattatc tataaagatt ttaggaacta cgttcatggt atcctggcga atattaaaac
```

FIG. 22 (CONT.)

```
39601 tatcaatgat atgattatcg ttttcatctt ttatcaccat atagtttcta agatatggga
39661 ttttacttaa tataatatta tttcccgtaa taaattttat tagaaatgcc aaatctataa
39721 gaaaagtcct cgaattagtt tgaagaatat ctatatcgcc gtaccgtata tttggattaa
39781 ttagatatag agaatatgat ccgtaacata tacaactttt attatggcgt ctaagatatt
39841 cttccatcaa cttattaaca tttttgacta gggaagatac attatgacgt cccattactt
39901 ttgccttgtc tattactgcg acgttcatag aatttagcat atctcttgcc aattcttcca
39961 ttgatgttac attataagaa attttagatg aaattacatt tggagcttta atagtaagaa
40021 ctcctaatat gtccgtgtat gtggtcacta atacagattg tagttctata atcgtaaata
40081 atttacctat attatatgtt tgagtctgtt tagaaaagta gctaagtata cgatctttta
40141 tttctgatgc agatgtatca acatcggaaa aaaatctttt tttattcttt tttactaaag
40201 atacaaatat gtctttgtta aaaacagtta ttttctgaat atttctagct tgtaatttta
40261 acatatgata ttcgttcaca ctaggtactc tgcctaaata ggtttctata atctttaatg
40321 taatattagg aaaagtattc tgatcaggat tcctattcat tttgaggatt taaaactctg
40381 attattgtct aatatggtct caacacaaac tttttcacag agcgatagag tttttgataa
40441 ctcgtttttc ttaagaaata taaaactact gtctccagag ctcgctctat cttttatttt
40501 atttaattcg atacaaactc ctgatactgg ttcagaaagt aattcattaa ttttcagtcc
40561 tttatagaag atatttaata tagataatac aaaatcttca gtttttgata tcgatctgat
40621 tgatcctaga actagatata ttaataacgt gctcattagg cagtttatgg cagcttgata
40681 attagatata gtatattcca gttcatattt attagatacc gcattgccca gattttgata
40741 ttctatgaat tcctctgaaa ataaatccaa aataactaga cattctattt tttgtggatt
```

FIG. 22 (CONT.)

```
40801 agtgtactct cttccctcta tcatgttcac tactggtgtc cacgatgata aatatctaga
40861 gggaatataa tatagtccat aggatgccaa tctagcaatg tcgaataact gtaattttat
40921 tcttcgctct tcattatgaa ttgattcttg aggtataaac ctaacacaaa ttatattatt
40981 agacttttcg tatgtaatgt ctttcatgtt ataagttttt aatcctggaa tagaatctat
41041 tttaatgagg cttttaaacg cagagttctc caacgagtca aagcataata ctctgttggt
41101 tttcttatat acgatgttac gattttcttc tttgaatgga ataggttttt gaattagttt
41161 ataattacaa cataatagat aaggaagtgt gcaaatagta cgcggaaaaa acataatagc
41221 tcccctgttt tcatccatgg ttttaagtaa atgatcactg gcttctttag tcaatggata
41281 ttcgaacatt aaccgtttca tcatcattgg acagaatcca tatttcttaa tgtaaagagt
41341 gatcaaatca ttgtgtttat tgtaccatct tgttgtaaat gtgtattcgg ttatcggatc
41401 tgctcctttt tctattaaag tatcgatgtc gatctcgtct aagaattcaa ctatatcgac
41461 atatttcatt tgtatacaca taaccattac taacgtagaa tgtataggaa gagatgtaac
41521 gggaacaggg tttgttgatt cgcaaactat tctaatacat aattcttctg ttaatacgtc
41581 ttgcacgtaa tctattatag atgccaagat atctatataa ttattttgta agatgatgtt
41641 aactatgtga tctatataag tagtgtaata attcatgtat ttcgatatat gttccaactc
41701 tgtctttgtg atgtctagtt tcgtaatatc tatagcatcc tcaaaaaata tattcgcata
41761 tattcccaag tcttcagttc tatcttctaa aaaatcttca acgtatggaa tataataatc
41821 tattttacct cttctgatat cattaatgat atagttttg acactatctt ctgtcaattg
41881 attcttattc actatatcta agaaacggat agcgtcccta ggacgaacta ctgccattaa
41941 tatctctatt atagcttctg gacataattc atctattata ccagaattaa tgggaactat
42001 tccgtatcta tctaacatag ttttaagaaa gtcagaatct aagacctgat gttcatatat
```

FIG. 22 (CONT.)

```
42061 tggttcatac atgaaatgat ctctattgat gatagtgact atttcattct ctgaaaattg
42121 gtaactcatt ctatatatgc tttccttgtt gatgaaggat agaatatact caatagaatt
42181 tgtaccaaca aactgttctc ttatgaatcg tatatcatca tctgaaataa tcatgtaagg
42241 catacattta acaattagag acttgtctcc tgttatcaat atactattct tgtgataatt
42301 tatgtgtgag gcaaatttgt ccacgttctt taattttgtt atagtagata tcaaatccaa
42361 tggagctaca gttcttggct taaacagata tagtttttct ggaacgaatt ctacaacatt
42421 attataaagg actttgggta gataagtggg atgaaatcct attttaatta atgcgatagc
42481 cttgtcctcg tgcagatatc caaacgcttt tgtgatagta tggcattcat tgtctagaaa
42541 cgctctacga atatctgtga cagatatcat ctttagagaa tatactagtc gcgttaatag
42601 tactacaatt tgtatttttt aatctatctc aataaaaaaa ttaatatgta tgattcaatg
42661 tataactaaa ctactaactg ttattgataa ctagaatcag aatctaatga tgacgtaacc
42721 aagaagttta tctactgcca atttagctgc attattttta gcatctcgtt tagattttcc
42781 atctgcctta tcgaatactc ttccgtcgat atctacacag gcataaaatg taggagagtt
42841 actaggcccc actgattcaa tacgaaaaga ccaatctctc ttagttattt ggcagtactc
42901 attaataatg gtgacagggt tagcatcttt ccaatcaata atttttttag ccggaataac
42961 atcatcaaaa gacttatgat cctctctcat tgattttttcg cgggatacat catctattat
43021 ggcgtcagcc ataacatcag catccggctt atccgcctcc gttgtcataa accaacgagg
43081 aggaatatcg tcggagctgt acaccatagc actacgttga agatcgtaca gagctttatt
43141 aacttctcgc ttctccatat taagttgtct agttagttgt gcagcagtag ctccttcgat
43201 tccaatgttt ttaatagccg cacacacaat ctctgcgtca gaacgctcgt caatatagat
43261 cttagacatt tttagagaga actaacacaa ccagcaataa aactaattta ttttatcatt
```

FIG. 22 (CONT.)

```
43321 tttttattca tcatcctctg gtggttcgtc gtttctatcg aatgtggatc tgattaaccc
43381 gtcatctata ggtgatgctg gttctggaga ttctggagga gatggattat tatctggaag
43441 aatctctgtt atttccttgt tttcatgtat cgattgcgtt gtaacattaa gattgcgaaa
43501 tgctctaaat ttgggaggct taaagtgttg tttgcaatct ctacacgcat gtctaactag
43561 tggaggttcg tcagcggctc tagtttgaat catcatcggc gtagtattcc tacttttaca
43621 gttaggacac ggtgtattgt atttctcgtc gagaacgtta aaataatcgt tgtaactcac
43681 atcctttatt ttatctatat tgtattctac tcctttctta atgcatttta taccgaataa
43741 gagatagcga aggaattctt tttcggtgcc gctagtaccc ttaatcatat cacatagtgt
43801 tttatattcc aaatttgtgg caatagacgg tttatttcta tacgatagtt tgtttctgga
43861 atcctttgag tattctatac caatattatt ctttgattcg aatttagttt cttcgatatt
43921 agattttgta ttacctatat tcttgatgta gtactttgat gattttttcca tggcccattc
43981 tattaagtct tccaagttgg catcatccac atattgtgat agtaattctc ggatatcagt
44041 agcggctacc gccattgatg tttgttcatt ggatgagtaa ctactaatgt atacattttc
44101 catttataac acttatgtat taactttgtt catttatatt ttttcattat tatgttgata
44161 ttaacaaaag tgaatatata tgttaataat tgtattgtgg ttatacggct acaatttcat
44221 aatgagtgga agtcagtgtc cgatgatcaa tgacgatagc tttactctga aaagaaagta
44281 tcaaatcgat agtgcggagt caacaataaa aatggataag aagaggataa agtttcagaa
44341 tagagccaaa atggtaaaag aaataaatca gacaataaga gcagcacaaa ctcattacga
44401 gacattgaaa ctaggataca taaaatttaa gagaatgatt aggactacta ctctagaaga
44461 tatagcacca tctattccaa ataatcagaa aacttataaa ctattctcgg acatttcagc
```

FIG. 22 (CONT.)

```
44521 catcggcaaa gcatcacaga atccgagtaa gatggtatat gctctgctgc tttacatgtt
44581 tcccaatttg tttggagatg atcatagatt cattcgttat agaatgcatc caatgagtaa
44641 aatcaaacac aagatcttct ctcctttcaa acttaatctt attagaatat tagtggaaga
44701 aagattctat aataatgaat gcagatctaa taaatggaga ataattggaa cacaagttga
44761 taaaatgttg atagctgaat ctgataaata tacaatagat gcaaggtata acctaaaacc
44821 catgtataga atcaagggaa aatctgaaga agataccctc tttatcaaac agatggtaga
44881 acaatgtgtg acatcccagg aattggtgga aaaagtgttg aagatactgt ttagagattt
44941 gttcaagagt ggagaataca aagcgtacag atacgatgat gatgtagaaa atggatttat
45001 tggattggat acactaaaat taaacattgt tcatgatata gttgaaccat gtatgcctgt
45061 tcgtaggcca gtggctaaga tactgtgtaa agaaatggta aataaatact ttgagaatcc
45121 gctacatatt attggtaaaa atcttcaaga gtgcattgac tttgttagtg aataggcatt
45181 tcatctttct ccaatactaa ttcaaattgt taaattaata atggatagta taaatagtta
45241 ttagtgataa aatagtaaaa ataattatta gaataagagt gtagtatcat agataactct
45301 cttctataaa aatggatttt attcgtagaa agtatcttat atacacagta gaaaataata
45361 tagatttttt aaaggatgat acattaagta aagtaaacaa ttttaccctc aatcatgtac
45421 tagctctcaa gtatctagtt agcaattttc ctcaacacgt tattactaag gatgtattag
45481 ctaataccaa tttttttgtt ttcatacata tggtacgatg ttgtaaagtg tacgaagcgg
45541 ttttacgaca cgcatttgat gcacccacgt tgtacgttaa agcattgact aagaattatt
45601 tatcgtttag taacgcaata caatcgtaca aggaaaccgt gcataaacta acacaagatg
45661 aaaaattttt agaggttgcc gaatacatgg acgaattagg agaacttata ggcgtaaatt
45721 atgacttagt tcttaatcca ttatttcacg gaggggaacc catcaaagat atggaaatca
```

FIG. 22 (CONT.)

```
45781 tttttttaaa actgtttaag aaaacagact tcaaagttgt taaaaaatta agtgttataa
45841 gattacttat ttgggcttac ctaagcaaga aagatacagg catagagttt gcggataatg
45901 atagacaaga tatatacact ctatttcaac aaactggtag aatagtccat agcaatctaa
45961 cagaaacgtt tagagattat atctttcccg gagataagac tagctattgg gtgtggttaa
46021 acgaaagtat agctaatgat gcggatattg ttcttaatag acacgccatt accatgtatg
46081 ataaaattct tagttatata tactctgaga taaaacaagg acgcgttaat aaaaacatgc
46141 ttaagttagt ttatatcttt gagcctgaaa aagatatcag agaacttctg ctagaaatca
46201 tatatgatat tcctggagat atcctatcta ttattgatgc aaaaaacgac gattggaaaa
46261 aatattttat tagtttttat aaagctaatt ttattaacgg taatacattt attagtgata
46321 gaacgtttaa cgaggactta ttcagagttg ttgttcaaat agatcccgaa tatttcgata
46381 atgaacgaat tatgtcttta ttctctacga gtgctgcgga cattaaacga tttgatgagt
46441 tagatattaa taacagttat atatctaata taatttatga ggtgaacgat atcacattag
46501 atacaatgga tgatatgaag aagtgtcaaa tctttaacga ggatacgtcg tattatgtta
46561 aggaatacaa tacatacctg tttttgcacg agtcggatcc catggtcata gagaacggaa
46621 tactaaagaa actgtcatct ataaaatcca agagtagacg gctgaacttg tttagcaaaa
46681 acatttaaaa atattattta gacggacaat tggctcgtct aggtcttgtg ttagatgatt
46741 ataaaggaga cttgttagtt aaaatgataa accatcttaa gtctgtggag gatgtatccg
46801 cattcgttcg atttctacaa gataaaaacc ctagtattct tccatcgcta atcaaaacta
46861 ttttagctag ttataatatt tccatcatcg tcttatttca aaggtttttg agagataatc
46921 tatatcatgt agaagaattc ttggataaaa gcatccatct aaccaagacg gataagaaat
46981 atatacttca attgataaga cacggtagat catagaacag accaaatata ttattaataa
```

FIG. 22 (CONT.)

```
47041 tttgtatata catagatata attatcacac atttttgata aatgggaact gctgcaacaa
47101 ttcagactcc caccaaatta atgaataaag aaaatgcaga aatgattttg gaaaaaattg
47161 ttgatcatat agttatgtat attagtgacg aatcaagtga ttcagaaaat aatcctgaat
47221 atattgattt tcgtaacaga tacgaagact atagatctct cattataaaa agtgatcacg
47281 agtttgtaaa gctatgtaaa aatcatgcag agaaaagttc tccagaaacg caacaaatga
47341 ttatcaaaca catatacgaa caatatctta ttccagtatc tgaagtacta ttaaaaccta
47401 taatgtccat gggtgacata attacatata acggatgtaa agacaatgaa tggatgctag
47461 aacaactctc taccctaaac tttaacaatc tccgcacatg gaactcatgt agcataggca
47521 atgtaacgcg tctgttttat acatttttta gttatctgat gaaagataaa ctaaatatat
47581 aagtataatc ccattctaat actttaacct gatgtattac ctgcatctta ttagaatatt
47641 aacctaacta aaagacataa catagttgat aaaaagcggt aggatataaa tattatggct
47701 gccaccgttc cgcgttttga cgacgtgtac aaaaatgcac aaagaagaat tctagatcaa
47761 gaaacatttt ttagtagagg tctaagtaga ccgttaatga aaaacacata tctatttgat
47821 aattacgcgt atggatggat accagaaact gcaatttgga gtagtagata cgcaaactta
47881 gatgcaagtg actattatcc catttcgttg ggattactta aaaagttcga gtttctcatg
47941 tctctatata aaggtcctat tcccgtatat gaagaaaaag taaatactga attcattgct
48001 aatggatcgt tctctggtag atacgtatca tatcttcgaa agttttctgc ccttccaaca
48061 aacgagttta ttagtttttt gttactgact tccattccaa tctataatat cttgttctgg
48121 tttaaaaata ctcagtttga tattactaaa cacacattat tcagatacgt ctatacagat
48181 aatgccaaac acctggcgtt ggctaggtat atgcatcaaa caggagacta taagcctttg
```

FIG. 22 (CONT.)

```
48241 tttagtcgtc tcaaagagaa ttatatattt accggtcccg ttccaataag tatcaaagat
48301 atagatcacc ctaatcttag tagagcaaga agtccatccg attatgagac attagctaat
48361 attagtacta tattgtactt taccaagtat gatccggtat taatgttttt attgttttac
48421 gtacctgggt attcaattac tacaaaaatt actccagccg tagaatatct aatggataaa
48481 ctgaatctaa caaagagcga cgtacaactg ttgtaaatta ttttatgctt cgtaaaatgt
48541 aggttttgaa ccaaacattc tttcaaagaa tgagatgcat aaaactttat tatccaatag
48601 attgactatt tcggacgtca atcgtttaaa gtaaacttcg taaaatattc tttgatcact
48661 gccgagttta aaacttctat cgataattgt ttcatatgtt ttaatattta caagtttttt
48721 ggtccatggt acattagccg gacaaatata tgcaaaataa tatcgttctc caagttctat
48781 agtttctgga ttatttttat tatattcagt aaccaaatac atattagggt tatctgcgga
48841 tttataattt gagtgatgca ttcgactcaa cataaataat tctagaggag acgatctact
48901 atcaaattcg gatcgtaaat ctgtttctaa agaacggaga atatctatac atacctgatt
48961 agaattcatc cgtccttcag acaacatctc agacagtctg gtcttgtatg tcttaatcat
49021 attcttatga aacttggaaa catctcttct agtttcacta gtacctttat taattctctc
49081 aggtacagat tttgaattcg acgatgctga gtatttcatc gttgtatatt tcttcttcga
49141 ttgcataatc agattcttat ataccgcctc aaactctatt ttaaaattat taaacaatac
49201 tctattatta atcagtcgtt ctaactcttt cgctatttct atagacttat cgacatcttg
49261 actgtctatc tctgtaaaca cggagtcggt atctccatac acgctacgaa aacgaaatct
49321 gtaatctata ggcaacgatg ttttcacaat cggattaata tctctatcgt ccatataaaa
49381 tggattactt aatggattgg caaaccgtaa cataccgtta gataactctg ctccatttag
49441 taccgattct agatacaaga tcattctacg tcctatggat gtgcaactct tagccgaagc
```

FIG. 22 (CONT.)

```
49501 gtatgagtat agagcactat ttctaaatcc catcagacca tatactgagt tggctactat
49561 cttgtacgta tattgcatgg aatcatagat ggccttttca gttgaactgg tagcctgttt
49621 tagcatcttt ttatatctgg ctctctctgc caaaaatgtt cttaatagtc taggaatggt
49681 tccttctatc gatctatcga aaattgctat ttcagagatg aggttcggta gtctaggttc
49741 acaatgaacc gtaatatatc taggaggtgg atatttctga agcaagagct gattatttat
49801 ttcttcttcc aatctattgg tactaacaac gacaccgact aatgtttccg gagatagatt
49861 tccaaagata cacacattag gatacagact gttataatca aagattaata cattattact
49921 aaacattttt tgttttggag caaatacctt accgccttca taaggaaact tttgttttgt
49981 ttctgatcta actaagatag ttttagtttc caacaatagc tttaacagtg gacccttgat
50041 gactgtactc gctctatatt cgaataccat ggattgagga agcacatatg ttgacgcacc
50101 cgcgtctgtt tttgtttcta ctccataata ctcccacaaa tactgacaca aacaagcatc
50161 atgaatacag tatctagcca tatctaaagc tatgtttaga ttataatcct tatacatctg
50221 agctaaatca acgtcatcct ttccgaaaga taatttatat gtatcattag gtaaagtagg
50281 acatgatagt acgactttaa atccattttc ccaaatatct ttacgaatta ctttacatat
50341 aatatcctca tcaacagtca cataattacc tgtggttaaa acctttgcaa atgcagcggc
50401 tttgcctttc gcgtccgtag tatcgtcacc gatgaacgtc atttctctaa ctcctctatt
50461 taatacttta cccatgcaac tgaacgcgtt cttggatata gaatccaatt tgtacgaatc
50521 caatttttca gatttttgaa tgaatgaata tagatcgaaa aatatagttc cattattgtt
50581 attaacgtga aacgtagtat tggccatgcc gcctactccc ttatgactag actgatttct
50641 ctcataaata cagagatgta cagcttcctt tttgtccgga gatctaaaga taatcttctc
50701 tcctgttaat aactctagac gattagtaat atatctcaga tcaaagttat gtccgttaaa
```

FIG. 22 (CONT.)

```
50761 ggtaacgacg tagtcgaacg ttagttccaa caattgttta gctattcgta acaaaactat
50821 ttcagaacat agaactagtt ctcgttcgta atccatttcc attagtgact gtatcctcaa
50881 acatcctcta tcgacggctt cttgtatttc ctgttccgtt aacatctctt cattaatgag
50941 cgtaaacaat aatcgtttac cacttaaatc gatataacag taacttgtat gcgagattgg
51001 gttaataaat acagaaggaa acttcttatc gaagtgacac tctatatcta gaaataagta
51061 cgatcttggg atatcgaatc taggtatttt tttagcgaaa cagttacgtg gatcgtcaca
51121 atgataacat ccattgttaa tctttgtcaa atattgctcg tccaacgagt aacatccgtc
51181 tggagatatc ccgttagaaa tataaaacca actaatattg agaaattcat ccatggtggc
51241 attttgtatg ctgcgtttct ttggctcttc tatcaaccac atatctgcga cggagcattt
51301 tctatcttta atatctagat tataacttat tgtctcgtca atgtctatag ttctcatctt
51361 tcccaacggc ctcgcattaa atggaggagg agacaatgac tgatatattt cgtccgtaac
51421 tacgtaataa aagtaatgag gaaatcgtat aaatacggtc tcgccatttc gacatctgga
51481 tttcagatat aaaaatctgt tttcaccgtg actttcaaac caattaatgc accgaacatc
51541 catttataga atttagaaat atattttcat ttaaatgaat cccaaacatt ggggaagagc
51601 cgtatggacc attattttta tagtactttc gcaagcgggt ttagacggca acatagaagc
51661 gtgtaaacga aaactatata ctatagtcag cactcttcca tgtcctgcat gtagacggca
51721 cgcgactatc gctatagagg acaataatgt catgtctagc gatgatctga attatattta
51781 ttattttttc atcagattat ttaacaattt ggcatctgat cccaaatacg cgatcgatgt
51841 gacaaaggtt aaccctttat aaacttaacc cattataaaa cttatgatta gtcacgactg
51901 aaataaccgc gtgattattt tttggtataa ttctacacgg catggtttct gtaactatga
```

FIG. 22 (CONT.)

```
51961 attcaacccc cgttacatta gtgaaatctt taacaaacag caagggttcg tcaaagacat
52021 aaaactcatt gtttacaatc gaaatagacc ccctatcaca cttaaaataa aaaatatcct
52081 tatcctttac caccaaataa aattctgatt ggtcaatgtg aatgtattca cttaacagtt
52141 ccacaaattt atttattaac tccgaggcac atacatcgtc ggtatttttt atggcaaact
52201 ttactcttcc agcatccgtt tctaaaaaaa tattaacgag ttccatttat atcatccaat
52261 attattgaaa tgacgttgat ggacagatga tacaaataag aaggtacggt acctttgtcc
52321 accatctcct ccaattcatg ctctattttg tcattaactt taatgtatga aaacagtacg
52381 ccacatgctt ccatgacagt gtgtaacact ttggatacaa aatgtttgac attagtataa
52441 ttgtccaaga ctgtcaatct ataatagata gtagctataa tatattctat gatggtattg
52501 aagaagatga caatcttggc atattgatca tttaacacag acatggtatc aacagatagc
52561 ttgaatgaaa gagaatcagt aattggaata agcgtcttct cgatagagtg tccgtatacc
52621 aacatgtctg atatttgat gtattccatt aaattattta gtttttctt tttattctcg
52681 ttaaacagca tttctgtcaa cggaccccaa catcgttgac cgattaagtt ttgattgatt
52741 tttccgtgta aggcgtatct agtcagatcg tatagcctat ccaataatcc atcatctgtg
52801 cgtagatcac atcgtacact ttttaattct ctatagaaga gcgacagaca gcaatttctt
52861 tattctctac agatgtaaga tacttgaaga cattcctatg atgatgcaga attttggata
52921 acacggtatt gatggtatct gttaccataa ttcctttgat ggctgatagt gtcagagcac
52981 aagatttcca atctttgttt tgatatctat atcagacagc atggtgcgtc tgacaacaca
53041 aggattaaga cggaaagatg aaatgattct ctcaacatct tcaatggata ccttgctatt
53101 ttttctggca ttatctatat gtgcgagaat atcctctaga gaatcagtat ccttttgat
53161 gatagtggat ctcaatgaca tgggacgtct aaaccttctt attctatcac cagattgcat
```

FIG. 22 (CONT.)

```
53221 ggtgatttgt cttctttctt ttatcataat gtaatctcta aattcatcgg caaattgtct
53281 atatctaaaa tcataatatg agatgtttac ctctacaaat atctgttcgt ccaatgttag
53341 agtatctaca tcagttttgt attccaaatt aaacatggca acggatttaa ttttatattc
53401 ctctattaag tcctcgtcga taataacaga atgtagataa tcatttaatc catcgtacat
53461 ggttggaaga tgcttgttga caaaatcttt aattgtcttg atgaaggtgg gactatatct
53521 aacatcttga ttaataaaat ttataacatt gtccatagga tactttgtaa ctagttttat
53581 acacatctct tcatcggtaa gtttagacag aatatcgtga acaggtggta tattatattc
53641 atcagatata cgaagaacaa tgtccaaatc tatattgttt aatatattat atagatgtag
53701 cgtagctcct acaggaatat ctttaactaa gtcaatgatt tcatcaaccg ttagatctat
53761 tttaaagtta atcatatagg cattgatttt taaaaggtat gtagccttga ctacattctc
53821 attaattaac cattccaagt cactgtgtgt aagaagatta tattctatca taagcttgac
53881 tacatttggt cccgatacca ttaaagaatt cttatgatat aaggaaacag attttaggta
53941 ctcatctact ctacaagaat tttggagagc cttaacgata tcagtgacgt ttattatttc
54001 aggaggaaag aatctaacat tgagaatatc ggaattaata gcttccagat acagtgattt
54061 tggcaatagt ccgtgtaatc cataatccag taacacgagc tggtgcttgc tagacacctt
54121 ttcaatgttt aatttttttg aaataagctt tgataaagcc ttcctcgcaa attccggata
54181 catgaacatg tcggcgacat gattaagtat tgtttttca ttattttctc aacaagttct
54241 caatacccca atagatgata gaatatcacc caatgcgtcc atgttgtcta tttccaacag
54301 gtcgctatat ccaccaatag aagtttttcc aaaaaagatt ctaggaacag ttctaccacc
54361 agtaatttgt tcaaaatagt cacgcaattc attttcgggt ttaaattctt taatatcgac
54421 aatttcatac gctcctcttt tgaaactaaa cttatttaga atatccagtg catttctaca
```

FIG. 22 (CONT.)

```
54481 aaaaggacat gtatacttga caaaaattgt cactttgtta ttggccaacc tttgttgtac
54541 aaattcctcg gccattttaa tatttaagtg atataaaact atctcgactt atttaactct
54601 ttagtcgaga tatatggacg cagatagcta tatgatagcc aactacagaa ggcaaacgct
54661 ataaaaaaca taattacgac gagcatattt ataaatattt ttattcagca ttacttgata
54721 tagtaatatt aggcacagtc aaacattcaa ccactctcga tacattaact ctctcatttt
54781 ctttaacaaa ttctacaata tcttcgtaaa aagattcttg aaacttttta gaatatctat
54841 cgactctaga tgaaatagcg ttcgtcaaca tactatgttt tgtatacata aaggcgccca
54901 ttttaacagt ttctagtgac aaaatgctag cgatcctagg atcctttaga atcacataga
54961 ttgacgattc gtctctctta gtaactctag taaaataatc atacaatcta gtacgcgaaa
55021 taatattatc cttgacttga ggagatctaa acaatctagt tttgagaaca tcgataagtt
55081 catcgggaat gacatacata ctatctttaa tagaactctt ttcatccagt tgaatggatt
55141 cgtccttaac caactgatta atgagatctt ctattttatc attttccaga tgatatgtat
55201 gtccattaaa gttaaattgt gtagcgcttc tttttagtct agcagccaat actttaacat
55261 cactaatatc gatatacaaa ggagatgatt tatctatggt attaagaatt cgtttttcga
55321 catctgtcaa aaccaattcc tttttgcctg tatcatccag ttttccatcc tttgtaaaga
55381 aattattttc tactagacta ttaataagac tgataaggat tcctccataa ttgcacaatc
55441 caaacttttt aacaaaacta gactttacaa gatctacagg aatgcgtaat tcaggtttct
55501 tagcttgtga tttttctttt tgtggacatt ttcttgtgac caactcatct accatttcat
55561 tgattttagc agtgaaataa gctttcaatg cacgggcact gatactattg aaaacgagtt
55621 gatcttcaaa ttccgccatt taagttcacc aaacaacttt taaatacaaa tatatcaata
```

FIG. 22 (CONT.)

```
55681 gtagtagaat aagaactata aaaaaaataa taattaacca ataccaaccc caacaaccgg
55741 tattattagt tgatgtgact gttttctcat cacttagaac agatttaaca atttctataa
55801 agtctgtcaa atcatcttcc ggagacccca taaatacacc aaatatagcg gcgtacaact
55861 tatccattta tacattgaat attggctttt ctttatcgct atcttcatca tattcatcat
55921 caatatcaac aagtcccaga ttacgagcca gatcttcttc tacattttca gtcattgata
55981 cacgttcact atctccagag agtccgataa cgttagccac cacttctcta tcaatgatta
56041 gtttcttgag tgcgaatgta atttttgttt ccgttccgga tctatagaag acgataggtg
56101 tgataattgc cttggccaat tgtctttctc ttttactgag tgattctagt tcaccttcta
56161 tagatctgag aatggatgat tctccagtcg aaacatattc taccatggat ccgtttaatt
56221 tgttgatgaa gatggattca tccttaaatg ttttctctgt aatagtttcc accgaaagac
56281 tatgcaaaga atttggaatg cgttccttgt gcttaatgtt tccatagacg gcttctagaa
56341 gttgatacaa cataggacta gccgcggtaa cttttatttt tagaaagtat ccatcgcttc
56401 tatcttgttt agatttattt ttataaagtt tagtctctcc ttccaacata ataaaagtgg
56461 aagtcatttg actagataaa ctatcagtaa gttttataga gatagacgaa caattagcgt
56521 attgagaagc atttagtgta acgtattcga tacattttgc attagattta ctaatcgatt
56581 ttgcatactc tataacaccc gcacaagtct gtagagaatc gctagatgca gtaggtcttg
56641 gtgaagtttc aactctcttc ttgattacct tactcatgat taaacctaaa taattgtact
56701 ttgtaatata atgatatata ttttcacttt atctcatttg agaataaaaa tgtttttgtt
56761 taaccactgc atgatgtaca gatttcggaa tcgcaaacca ccagtggttt tattttatcc
56821 ttgtccaatg tgaattgaat gggagcggat gcgggtttcg tacgtagata gtacattccc
56881 gtttttagac cgagactcca tccgtaaaaa tgcatactcg ttagtttgga ataactcgga
```

FIG. 22 (CONT.)

```
56941 tctgctatat ggatattcat agattgactt tgatcgatga aggctcccct gtctgcagcc
57001 atttttatga tcgtcttttg tggaatttcc caaatagttt tataaactcg cttaatatct
57061 tctggaaggt ttgtattctg aatggatcca ccatctgcca taatcctatt cttgatctca
57121 tcattccata attttctctc ggttaaaact ctaaggagat gcggattaac tacttgaaat
57181 tctccagaca atactctccg agtgtaaata ttactggtat acggttccac cgactcatta
57241 tttcccaaaa tttgagcagt tgatgcagtc ggcataggtg ccaccaataa actatttcta
57301 agaccgtatg ttctgatttt atcttttaga ggttcccaat tccaaagatc cgacggtaca
57361 acattccaaa gatcatattg tagaataccg ttactggcgt acgatcctac atatgtatcg
57421 tatggtcctt ccttctcagc tagttcacaa ctcgcctcta atgcaccgta ataaatggtt
57481 tcgaagatct tcttatttag atcttgtgct tccaggctat caaatggata atttaagaga
57541 ataaacgcgt ccgctaatcc ttgaacacca ataccgatag gtctatgtct cttattagag
57601 atttcagctt ctggaatagg ataataatta atatctataa ttttattgag atttctgaca
57661 attactttga ccacatcctt cagtttgaga aaatcaaatc gcccatctat tacaaacatg
57721 ttcaaggcaa cagatgccag attacaaacg gctacctcat tagcatccgc atattgtatt
57781 atctcagtgc aaagattact acacttgata gttcctaaat tttgttgatt actctttttg
57841 ttacacgcat ccttataaag aatgaatgga gtaccagttt caatctgaga ttctataatc
57901 gctttccaga cgactcgagc ctttattata gatttgtatc tcctttctct ttcgtatagt
57961 gtatacaatc gttcgaactc gtctccccaa acattgtcca atccaggaca ttcatccgga
58021 cacatcaacg accactctcc gtcatccttc actcgtttca taaagagatc aggaatccaa
58081 agagctataa atagatctct ggttctatgt tcctcgtttc ctgtattctt tttaagatcg
58141 aggaacgcca taatatcaga atgccacggt tccaagtata tggccataac tccaggccgt
```

FIG. 22 (CONT.)

```
58201 ttgtttcctc cctgatctat gtatctagcg gtgttattat aaactctcaa cattggaata
58261 ataccgtttg atataccatt ggtaccggag atatagcttc cactggcacg aatattacta
58321 attgatagac ctattccccc tgccatttta gagattaatg cgcatcgttt taacgtgtca
58381 tagataccct ctatgctatc atcgatcatg ttaagtagaa aacagctaga catttggtga
58441 cgactagttc ccgcattaaa taaggtagga gaagcgtgcg taaaccattt ttcagaaagt
58501 agattgtacg tctcaatagc tgagtctata tcccattgat gaattcctac tgcgacacgc
58561 attaacatgt gctgaggtct ttcaacgatc ttgttgttta ttttcaacaa gtaggatttt
58621 tccaaagttt taaaaccaaa atagttgtat gaaaagtctc gttcgtaaat aataaccgag
58681 ttgagtttat ccttatattt gttaactata tccatggtga tacttgaaat aatcggagaa
58741 tgtttcccat ttttaggatt aacatagttg aataaatcct ccatcacttc actaaatagt
58801 tttttgtttt ccttgtgtag atttgatacg gctattctgg cggctagaat ggcataatcc
58861 ggatgttgtg tagtacaagt ggctgctatt tcggctgcca gagtgtccaa ttctaccgtt
58921 gttactccat tatatattcc ttgaataacc ttcatagcta ttttaatagg atctatatga
58981 tccgtgttta agccataaca taattttcta atacgagacg tgattttatc aaacatgaca
59041 ttttccttgt atccatttcg tttaatgaca aacatttttg ttggtgtaat aaaaaaaatt
59101 atttaacttt tcattaatag ggatttgacg tatgtagcgt acaaaattat cgttcctggt
59161 atatagataa agagtcctat atatttgaaa atcgttacgg ctcgattaaa ctttaatgat
59221 tgcatagtga atatatcatt aggatttaac tccttgacta tcatggcggc gccagaaatt
59281 accatcaaaa gcattaatac agttatgccg atcgcagtta gaacggttat agcatccacc
59341 atttatatct aaaaattaga tcaaagaata tgtgacaaag tcctagttgt atactgagaa
```

FIG. 22 (CONT.)

```
59401 ttgacgaaac aatgtttctt acatattttt tttttattag taaccgactt aatagtagga
59461 actggaaaac tagacttgat tattctataa gtatagatac ccttccaaat aatattctct
59521 ttgataaaag ttccagaaaa tgtagaattt tttaaaaagt tatcttttgc tattaccaag
59581 attgtgttta gacgcttatt attaatatga gtgatgaaat ccacaccgcc tctagatatc
59641 gcttttattt ccacattaga tggtaaatcc aatagtgaaa ctatcttttt aggaatgtat
59701 ggactcgcgt ttagaggagt gaacgtctta ggcgtcggaa aggatgattc atcaaacgaa
59761 taaacaattt cacaaatgga tgttaatgta ttagtaggaa attttttgac gctagtggaa
59821 ttgaagattc taatggatga tgttctacct atttcatccg ataacatgtt aatttccgac
59881 accaacggtt ttaatatttc gatgatatac ggtagtctct ctttcggact tatatagctt
59941 attccacaat acgagtcatt atatactcca aaaaacaaaa taactagtat aaaatctgta
60001 tcgaatggga aaaacgaaat tatcgacata ggtatagaat ctggaacatt gaacgtatta
60061 atacttaatt ctttttctgt ggtaagtacc gataggttat tgacattgta tggttttaaa
60121 tattctataa cttgagactt gatagatatt agtgatgaat tgaaaattat ttttatcacc
60181 acgtgtgttt caggatcatc gtcgacgccc gtcaaccaac cgaatggagt aaaataaata
60241 tcattaatat atgctctaga tattagtatt tttatcaatc ctttgattat catcttctcg
60301 taggcgaatg attccatgat caagagtgat ttaagaacat cctccggagt attaatgggc
60361 ttagtaaaca gtccatcgtt gcaataataa aagttatcca agttaaagga tattatgcat
60421 tcgtttaaag atatcacctc atctgacgga gacaattttt tggtaggttt tagagacttt
60481 gaagctactt gtttaacaaa gttattcatc gtcgtttact attctattta attttgtagt
60541 taatttatca catatcacat taattgactt tttggtccat ttttccatac gtttatattc
60601 ttttaatcct gcgttatccg tttccgttat atccagggat agatcttgca agttaaatag
```

FIG. 22 (CONT.)

```
60661 aatgctctta aataatgtca ttttcttatc cgctaaaaat ttaaagaatg tataaacctt
60721 tttcagagat ttgaaactct taggtggtgt cctagtacac aatatcataa acaaactaat
60781 aaacattcca cattcagatt ccaacagctg attaacttct acattaatac agcctatttt
60841 cgctccaaat gtacattcga aaaatctgaa taaaacatcg atgtcacaat ttgtattatc
60901 caatacagaa tgtttgtgat tcgtgttaaa accatcggag aaggaataaa aataaaaatt
60961 attatagtgg tggaattcag ttggaatatt gcctccggag tcataaaagg atactaaaca
61021 ttgtttttta tcataaatta cacatttcca atgagacaaa taacaaaatc caaacattac
61081 aaatctagag gtagaacttt taattttgtc tttaagtata tacgataaga tatgtttatt
61141 cataaacgcg tcaaattttt catgaatcgc taaggagttt aagaatctca tgtcaaattg
61201 tcctatataa tccacttcgg atccataagc aaactgagag actaagttct taatacttcg
61261 attgctcatc caggctcctc tctcaggctc tattttcatc ttgacgacct ttggattttc
61321 accagtatgt attcctttac gtgataaatc atcgatttc aaatccattt gtgagaagtc
61381 tatcgcctta gatacttttt cccgtagtcg aggtttaaag aaatacgcta acggtatact
61441 agtaggtaac tcaaagacat catatataga atggtaacgc gtctttaact cgtcggttaa
61501 ctctttcttt tgatcgagtt cgtcgctact attgggtctg ctcaggtgcc ccgactctac
61561 tagttccaac atcataccga taggaataca agacactttg ccggcggttg tagatttatc
61621 atatttctcc actacatatc cgttacaatt tgttaaaaat ttagatacat ctatattgct
61681 acataatcca gctagtgaat atatatgaca taataaattg gtaaatccta gttctggtat
61741 tttactaatt actaaatctg tatatctttc catttatcat ggaaaagaat ttaccagata
61801 tcttcttttt tccaaactgc gttaatgtat tctcttacaa atattcacaa gatgaattca
61861 gtaatatgag taaaacggaa cgtgatagtt tctcattggc ggtgtttcca gttataaaac
```

FIG. 22 (CONT.)

```
61921 atagatggca taacgcacac gttgtaaaac ataaaggaat atacaaagtt agtacagaag
61981 cacgtggaaa aaaagtatct cctccatcac taggaaaacc cgcacacata aacctaaccg
62041 cgaagcaata tatatacagt gaacacacaa taagctttga atgttatagt tttctaaaat
62101 gtataacaaa tacagaaatc aattcgttcg atgagtatat attaagagga ctattagaag
62161 ctggtaatag tttacagata ttttccaatt ccgtaggtaa acgaacagat actataggtg
62221 tactagggaa taagtatcca tttagcaaaa ttccattggc ctcattaact cctaaagcac
62281 aacgagagat attttcagcg tggatttctc atagacctgt agttttaact ggaggaactg
62341 gagtgggtaa gacgtcacag gtacccaagt tattgctttg gtttaattat ttatttggtg
62401 gattctctac tctagataaa atcactgact ttcacgaaag accagtcatt ctatctcttc
62461 ctaggatagc tttagttaga ttgcatagca ataccatttt aaaatcattg ggatttaagg
62521 tactagatgg atctcctatt tctttacggt acggatctat accggaagaa ttaataaaca
62581 aacaaccaaa aaaatatgga attgtatttt ctacccataa gttatctcta acaaaactat
62641 ttagttatgg cactcttatt atagacgaag ttcatgagca tgatcaaata ggagatatta
62701 ttatagcagt agcgagaaag catcatacga aaatagattc tatgttttta atgactgcca
62761 cgttagagga tgacagggaa cggctaaaag tatttttacc taatcccgca tttatacata
62821 ttcctggaga tacactgttt aaaattagcg aggtatttat tcataataag ataaatccat
62881 cttccagaat ggcatacata gaagaagaaa agagaaattt agttactgct atacagatgt
62941 atactcctcc tgatggatca tccggtatag tctttgtggc atccgttgca cagtgtcacg
63001 aatataaatc atatttagaa aaaagattac cgtatgatat gtatattatt catggtaagg
63061 tcttagatat agacgaaata ttagaaaaag tgtattcatc acctaatgta tcgataatta
```

FIG. 22 (CONT.)

```
63121 tttctactcc ttatttggaa tccagcgtta ctatacgcaa tgttacacac atttatgata
63181 tgggtagagt ttttgtcccc gctccttttg gaggatcgca agaatttatt tctaaatcta
63241 tgagagatca acgaaaagga agagtaggaa gagttaatcc tgggacatac gtatatttct
63301 atgatctgtc ttatatgaag tctatacagc gaatagattc agaatttcta cataattata
63361 tattgtacgc taataagttt aatctaacac tccccgaaga tttgtttata atccctacaa
63421 atttggatat tctatggcgt acaaaggaat atatagactc gttcgatatt agtacagaaa
63481 catggaataa attattatcc aattattata tgaagatgat agagtatgct aaactttatg
63541 tactaagtcc tattctcgct gaggagttgg ataattttga gaggacggga gaattaacta
63601 gtattgtaca agaagccatt ttatctctaa atttacgaat taagatttta aattttaaac
63661 ataaagatga tgatacgtat atacactttt gtaaaatatt attcggtgtc tataacggaa
63721 caaacgctac tatatattat catagacctc taacgggata tatgaatatg atttcagata
63781 ctatatttgt tcctgtagat aataactaaa aatcaaactc taatgaccac atcttttttt
63841 agagatgaaa aattttccac atctcctttt gtagacacga ctaaacattt tgcagaaaaa
63901 agtttattag tgtttagata atcgtatact tcatcagtgt agatagtaaa tgtgaacaga
63961 taaaaggtat tcttgctcaa tagattggta aattccatag aatatattaa tcctttcttc
64021 ttgagatccc acatcatttc aaccagagac gttttatcca atgatttacc tcgtactata
64081 ccacatacaa aactagattt tgcagtgacg tcgtatctgg tattcctacc aaacaaaatt
64141 ttacttttag ttcttttaga aaattctaag gtagaatctc tatttgccaa tatgtcatct
64201 atggaattac cactagcaaa aaatgataga aatatatatt gatacatcgc agctggtttt
64261 gatctactat actttaaaaa cgaatcagat tccataattg cctgtatatc atcagctgaa
64321 aaactatgtt ttacacgtat tccttcggca tttcttttta atgatatatc ttgtttagac
```

FIG. 22 (CONT.)

```
64381 aatgataaag ttatcatgtc catgagagac gcgtctccgt atcgtataaa tatttcatta
64441 gatgttagac gcttcattag gggtatactt ctataaggtt tcttaatcag tccatcattg
64501 gttgcgtcaa gaactactat cggatgttgt tgggtatctc tagtgttaca catggcctta
64561 ctaaagtttg ggtaaataac tatgatatct ctattaatta tagatgcata tatttcattt
64621 gtcaaggata ttagtatcga cttgctatcg tcattaatac gtgtaatgta atcatataaa
64681 tcatgcgata gccaaggaaa atttaaatag atgttcatca tataatcgtc gctataattc
64741 atattaatac gttgacattg actaatttgt aatatagcct cgccacgaag aaagctctcg
64801 tattcagttt catcgataaa ggataccgtt aaatataact ggttgccgat agtctcatag
64861 tctattaagt ggtaagtttc gtacaaatac agaatcccta aaatattatc taatgttgga
64921 ttaatcttta ccataactgt ataaaatgga gacggagtca taactatttt accgtttgta
64981 cttactggaa tagacgaagg aataatctcc ggacatgctg gtaaagaccc aaatgtctgt
65041 ttgaagaaat ccaatgttcc aggtcctaat ctcttaacaa aaattacgat attcgatccc
65101 gatatccttt gcattctatt taccagcata tcacgaacta tattaagatt atctatcatg
65161 tctattctcc caccgttata taaatcgcct ccgctaagaa acgttagtat atccatacaa
65221 tggaatactt catttctaaa atagtattcg ttttctaatt ctttaatgtg aaatcgtata
65281 ctagaaaggg aaaaattatc tttgagtttt ccgttagaaa agaaccacga aactaatgtt
65341 ctgattgcgt ccgattccgt tgctgaatta atggatttac accaaaaact catataactt
65401 ctagatgtag aagcattcgc taaaaaatta gtagaatcaa aggatataag tagatgttcc
65461 aacaagtgag caattcccaa gatttcatct atatcattct cgaatccgaa attagaaatt
65521 cccaagtaga tatccttttt catccgatcg ttgatgaaaa tacgaacttt attcggtaag
65581 acaatcattt actaaggagt aaaataggaa gtaatgttcg tatgtcgtta tcatcgtata
```

FIG. 22 (CONT.)

```
65641 aattaaaggt gtgtttttta ccattaagtg acattataat tttaccaata ttggaattat
65701 aatataggtg tatttgcgca ctcgcgacgg ttgatgcatc ggtaaatata gctgtatcta
65761 atgttctagt cggtatttca tcatttcgct gtctaataat agcgttttct ctatctgttt
65821 ccattacagc tgcctgaagt ttattggtcg gataatatgt aaaataataa gaaatacata
65881 cgaataacaa aaataaaata agatataata aagatgccat ttagagatct aattttgttt
65941 aacttgtcca aattcctact tacagaagat gaggaatcgt tggagatagt gtcttcctta
66001 tgtagaggat ttgaaatatc ttatgatgac ttgataactt actttccaga taggaaatac
66061 cataaatata tttctaaagt atttgaacat gtagatttat cggaggaatt aagtatggaa
66121 ttccatgata caactctgag agatttagtc tatcttagat tgtacaagta ttccaagtgt
66181 atacggccgt gttataaatt aggagataat ctaaaaggca tagttgttat aaaggacagg
66241 aatatttata ttagagaagc aaatgatgac ttgatagaat atctcctcaa ggaatacact
66301 cctcagattt atacatattc taatgagcgc gtccccataa ctggttcaaa attaattctt
66361 tgtggatttt ctcaagttac atttatggcg tatacaacgt cgcatataac aacaaataaa
66421 aaggtagatg ttctcgtttc caaaaaatgt atagatgaac tagtcgatcc aataaattat
66481 caaatacttc aaaatttatt tgataaagga agcggaacaa taaacaaaat actcaggaag
66541 atattttatt cggtaaccgg tggccaaact ccataatttg ctttttctat ttcggatttt
66601 agaatttcca aattcaccag cgatttatcg gttttggtga aatccaagga tttattaatg
66661 tccacaaatg ccatttgttt tgtctgtgga ttgtatttga aaatggaaac gatgtagtta
66721 gatagatgcg ctgcaaagtt tcctattagg gttccgcgct ttacgtcacc cagcatactt
66781 gaatcaccat cctttaaaaa aaatgataag atatcaacat ggagtatatc atactcggat
```

FIG. 22 (CONT.)

66841 tttaattctt ctactgcatc actgacattt tcacaaatac tacaatacgg tttaccgaaa
66901 ataatcagta cgttcttcat ttatgggtat caaaaactta aaatcgttac tgctggaaaa
66961 taaatcactg acgatattag atgataattt atacaaagta tacaatggaa tatttgtgga
67021 tacaatgagt atttatatag ccgtcgccaa ttgtgtcaga aacttagaag agttaactac
67081 ggtattcata aaatacgtaa acggatgggt aaaaaaggga gggcatgtaa cccttttat
67141 cgatagagga agtataaaaa ttaaacaaga cgttagagac aagagacgta aatattctaa
67201 attaaccaag gacagaaaaa tgctagaatt agaaaagtgt acatccgaaa tacaaaatgt
67261 taccggattt atggaagaag aaataaaggc agaaatgcaa ttaaaaatcg ataaactcac
67321 atttcaaata tatttatctg attctgataa cataaaaata tcattgaatg agatactaac
67381 acatttcaac aataatgaga atgttacatt attttattgt gatgaacgag acgcagaatt
67441 cgttatgtgt ctcgaggcta aaacacattt ctctaccaca ggagaatggc cgttgataat
67501 aagtaccgat caggatacta tgctatttgc atctactgat aatcatccta agatgataaa
67561 aaacttaact caactgttta aatttgttcc ctcggcagag gataactatt tagcaaaatt
67621 aacggcgtta gtgaatggat gtgatttctt tcctggactc tatggggcat ctataacacc
67681 caccaactta aacaaaatac aattgtttag tgattttaca atcgataata tagtcactag
67741 tttggcaatt aaaaattatt atagaaagac taactctacc gtagacgtgc gtaatattgt
67801 tacgtttata aacgattacg ctaatttaga cgatgtctac tcgtatgttc ctccttgtca
67861 atgcactgtt caagaattta tattttccgc attagatgaa aaatggaaca attttaaatc
67921 atcttattta gagaccgttc cgttaccctg ccaattaatg tatgcattag aaccacgcaa
67981 ggagattgat gtttcagaag ttaaaacttt atcatcttat atagatttcg aaaatactaa
68041 atcagatatc gatgttataa aatctatatc ttcgatcttc ggatattcta acgaaaactg

FIG. 22 (CONT.)

68101 taacactata gtgttcggca tctataagga taatttacta ctgagtataa atagttcatt
68161 ttactttaac gatagtctgt taataaccaa tactaaaagt gataatataa taaatatagg
68221 ttactagatt aaaaatggtg ttccaactcg tgtgctctac gtgcggcaaa gatatttctc
68281 acgaacgata taaattgatt atacgaaaaa aatcattaaa ggatgtactc gtcagtgtaa
68341 agaacgaatg ttgtaggtta aaattatcta cacaaataga acctcaacgt aacttaacag
68401 tgcaacctct attggatata aactaatatg gatccggtta attttatcaa gacatatgcg
68461 cctagaggtt ctattatttt tattaattat accatgtcat taacaagtca tttgaatcca
68521 tcgatagaaa aacatgtggg tatttattat ggtacgttat tatcggaaca cttggtagtt
68581 gaatctacct atagaaaagg agttcgaata gtcccattgg atagtttttt tgaaggatat
68641 cttagtgcaa aagtatacat gttagagaat attcaagtta tgaaaatagc agctgatacg
68701 tcattaactt tattgggtat tccgtatgga tttggtcata atagaatgta ttgttttaaa
68761 ttggtagctg aatgttataa aaatgccggt attgatacat cgtctaaacg aatattaggt
68821 aaagatattt ttctgagcca aaacttcaca gatgataata gatggataaa gatatatgat
68881 tctaataatt taacattttg gcaaattgat taccttaaag ggtgagttaa tatgcataac
68941 tactcctccg ttgttttttc cctcgttctt tttcttaacg ttgtttgcca tcactctcat
69001 aatgtaaaga tattctaaaa tggtaaactt ttgcatatcg gacgcagaaa ttggtataaa
69061 tgttgtaatt gtattatttc ccgtcaatgg actagtcaca gctccatcag ttttatatcc
69121 tttagagtat ttctcactcg tgtctaacat tctagagcat tccatgatct gtttatcgtt
69181 gatattggcc ggaaagatag attttttatt ttttattata ttactattgg caattgtaga
69241 tataacttct ggtaaatatt tttctacctt ttcaatctct tctattttca agccggctat
69301 atattctgct atattgttgc tagtatcaat accttttctg gctaagaagt catatgtggt

FIG. 22 (CONT.)

```
69361 attcactata tcagttttaa ctggtagttc cattagcctt tccacttctg cagaataatc
69421 agaaattggt tctttaccag aaaatccagc tactataata ggctcaccga tgatcattgg
69481 caaaatccta tattgtacca gattaatgag agcatatttc atttccaata attctgctag
69541 ttcttgagac attgatttat ttgatgaatc tagttggttc tctagatact ctaccatttc
69601 tgccgcatac aataacttgt tagataaaat cagggttatc aaagtgttta gcgtggctag
69661 aatagtgggc ttgcatgtat taaagaatgc ggtagtatga gtaaaccgtt ttaacgaatt
69721 atatagtctc cagaaatctg tggcgttaca tacatgagcc gaatgacatc gaagattgtc
69781 caatattttt aatagctgct ctttgtccat tatttctata tttgactcgc aacaattgta
69841 gataccatta atcactgatt ccttttcga tgccggacaa tagcacaatt gtttagcttt
69901 ggactctatg tattcagaat taatagatat atctctcaat acagattgca ctatacattt
69961 tgaaactatg tcaaaaattg tagaacgacg ctgttctgca gccatttaac tttaaataat
70021 ttacaaaaat ttaaaatgag catccgtata aaaatcgata aactgcgcca aattgtggca
70081 tatttttcag agttcagtga agaagtatct ataaatgtag actcgacgga tgagttaatg
70141 tatattttg ccgccttggg cggatctgta aacatttggg ccattatacc tctcagtgca
70201 tcagtgttct accgcggagc cgaaaacatt gtgtttaatc ttcctgtgtc caaggtaaaa
70261 tcgtgtttgt gtagttttca caatgatgcc atcatagata tagaacctga tctggaaaat
70321 aatctagtaa aactttctag ttatcatgta gtaagtgtcg attgtaacaa ggaactgatg
70381 cctattagga cagatactac tatttgtcta agtatagatc aaaagaaatc ttacgtgttt
70441 aattttcaca agtatgaaga aaaatgttgt ggtagaaccg tcattcattt agaatggttg
70501 ttgggcttta tcaagtgtat tagtcagcat cagcatttgg ctattatgtt taaagatgac
```

FIG. 22 (CONT.)

```
70561 aatattatta tgaagactcc tggtaatact gatgcgtttt ccagggaata ttctatgact
70621 gaatgttctc aagaactaca aaagttttct ttcaaaatag ctatctcgtc tctcaacaaa
70681 ctacgaggat tcaaaaagag agtcaatgtt tttgaaacta gaatcgtaat ggataatgac
70741 gataacattc taggaatgtt gttttcggat agagttcaat cctttaagat caacatcttt
70801 atgacgtttt tagattaata ctttcaatga gataaatatg ggtggcagag taagtgttga
70861 gctccctaaa cgggatccgc ctccgggagt acccactgat gagatgttat taaacgtgga
70921 taaaatgcat gacgtgatag ctcccgctaa gcttttagaa tatgtgcata taggaccact
70981 agcaaaagat aaagaggata aagtaaagaa aagatatcca gagtttagat tagtcaacac
71041 aggacccggt ggtctttcgg cattgttaag acaatcgtat aatggaaccg cacccaattg
71101 ctgtcgcact tttaatcgta ctcattattg gaaaaaggat ggaaagatat cagataagta
71161 tgaagagggt gcagtattag aatcgtgttg gccagacgtt cacgacactg gaaaatgcga
71221 tgttgattta ttcgactggt gtcaggggga tacgttcgat agaaacatat gccatcagtg
71281 gatcggttca gcctttaata ggagtgatag aactgtagag ggtcaacaat cgttaataaa
71341 tctgtataat aagatgcaaa cattatgtag taaagatgct agtgtaccaa tatgtgaatc
71401 atttttgcat catttacgcg cacacaatac agaagatagc aaagagatga tcgattatat
71461 tctaagacaa cagtctgcgg actttaaaca gaaatatatg agatgtagtt atcccactag
71521 agataagtta gaagagtcat taaaatatgc ggaacctcga gaatgttggg atccagagtg
71581 ttcgaatgcc aatgttaatt tcttactaac acgtaattat aataatttag gactttgcaa
71641 tattgtacga tgtaatacta gcgtgaacaa cttacagatg gataaaactt cctcattaag
71701 attgtcatgt ggattaagca atagtgatag attttctact gttcccgtca atagagcaaa
71761 agtagttcaa cataatatta aacattcgtt cgacctaaaa ttgcatttga tcagtttatt
```

FIG. 22 (CONT.)

```
71821 atctctcttg gtaatatgga tactaattgt agctatttaa atgggtgccg cggcaagcat
71881 acagacgacg gtgaatacac tcagcgaacg tatctcgtct aaattagaac aagaagcgaa
71941 cgctagtgct caaacaaaat gtgatataga aatcggaaat ttttatatcc gacaaaacca
72001 tggatgtaac ctcactgtta aaaatatgtg ctctgcggac gcggatgctc agttggatgc
72061 tgtgttatca gccgctacag aaacatatag tggattaaca ccggaacaaa aagcatacgt
72121 accagctatg tttactgctg cgttaaacat tcagacgagt gtaaacactg ttgttagaga
72181 ttttgaaaat tatgtgaaac agacttgtaa ttctagcgcg gtcgtcgata acaaattaaa
72241 gatacaaaac gtaatcatag atgaatgtta cggagcccca ggatctccaa caaatttgga
72301 atttattaat acaggatcta gcaaaggaaa ttgtgccatt aaagcgttga tgcaattgac
72361 gactaaggcc actactcaaa tagcacctag acaagttgct ggtacaggag ttcagtttta
72421 tatgattgtt atcggtgtta taatattggc agcgttgttt atgtactatg ccaagcgtat
72481 gttgttcaca tccaccaatg ataaaatcaa acttatttta gccaataagg aaaacgtcca
72541 ttggactact tacatggaca cattctttag aacttctccg atggttattg ctaccacgga
72601 tatgcaaaac tgaaaatata ttgataatat tttaatagat taacatggaa gttatcgctg
72661 atcgtctaga cgatatagtg aaacaaaata tagcggatga aaaatttgta gattttgtta
72721 tacacggtct agagcatcaa tgtcctgcta tacttcgacc attaattagg ttgtttattg
72781 atatactatt atttgttata gtaatttata tttttacggt acgtctagta agtagaaatt
72841 atcaaatgtt gttggcgttg gtggcgctag tcatcacatt aactattttt tattacttta
72901 tactataata gtactagact gacttctaac aaacatctca cctgccataa ataaatgctt
72961 gatattaaag tcttctattt ctaacactat tccatctgtg gaaaataata ctctgacatt
73021 atcgctaatt gacacatcgg tgagtgatat gcctataaag taataatctt ctttgggcac
```

FIG. 22 (CONT.)

```
73081 atataccagt gtaccaggtt ctaacaacct atttactggt gctcctgtag catacttttt
73141 ctttaccttg agaatatcca tcgtttgctt ggtcaatagc gatatgtgat tttttatcaa
73201 ccactcaaaa aagtaattgg agtgttcata tcctctacgg gctattgtct catggccgtg
73261 tatgaaattt aagtaacacg actgtggtag atttgttcta tagagccggt tgccgcaaat
73321 agatagaact accaatatgt ctgtacaaat gttaaacatt aattgattaa cagaaaaaac
73381 aatgttcgtt ctgggaatag aaaccagatc aaaacaaaat tcgttagaat atatgccacg
73441 tttatacatg gaatataaaa taactacagt ttgaaaaata acagtatcat ttaaacattt
73501 aacttgcggg gttaatttca caactttact gtttttaaac tgttcaaaat atagcatcga
73561 tccatgagaa atacgtttag ccgcctttaa tagaggaaat cccaccgcct ttctggatct
73621 caccaacgac gatagttctg accagcaact tatttcttca tcatccacct gttttaacat
73681 ataataggca ggagatagat atccgtcatt gcaatattcc ttttcgtagg cacacaatct
73741 aatattgata aaatctccat tctcttctct gcatttatta tcttgtttcg gtggctgatt
73801 aggctgtagt cttggtttag gctttggtat atcgttgttg aatctatttt ggtcattaaa
73861 tctttcattt cttcctggta tatttctatc acctcgtttg gttggatttt tgtctatatt
73921 atcgtttgta acatcggtac gggtattcat ttatcacaaa aaaaacttct ctaaatgagt
73981 ctactgctag aaaacctcat cgaagaagat accatatttt ttgcaggaag tatatctgag
74041 tatgatgatt tacaaatggt tattgccggc gcaaaatcca aatttccaag atctatgctt
74101 tctattttta atatagtacc tagaacgatg tcaaaatatg agttggagtt gattcataac
74161 gagaatatca caggggcaat gtttaccaca atgtataata taagaaacaa tttgggtcta
74221 ggagatgata aactaactat tgaagccatt gaaaactatt tcttggatcc taacaatgag
```

FIG. 22 (CONT.)

```
70561 aatattatta tgaagactcc tggtaatact gatgcgtttt ccagggaata ttctatgact
70621 gaatgttctc aagaactaca aaagttttct ttcaaaatag ctatctcgtc tctcaacaaa
70681 ctacgaggat tcaaaaagag agtcaatgtt tttgaaacta gaatcgtaat ggataatgac
70741 gataacattc taggaatgtt gttttcggat agagttcaat cctttaagat caacatcttt
70801 atgacgtttt tagattaata ctttcaatga gataaatatg ggtggcagag taagtgttga
70861 gctccctaaa cgggatccgc ctccgggagt acccactgat gagatgttat taaacgtgga
70921 taaaatgcat gacgtgatag ctcccgctaa gcttttagaa tatgtgcata taggaccact
70981 agcaaaagat aaagaggata aagtaaagaa aagatatcca gagtttagat tagtcaacac
71041 aggacccggt ggtctttcgg cattgttaag acaatcgtat aatggaaccg cacccaattg
71101 ctgtcgcact tttaatcgta ctcattattg gaaaaaggat ggaaagatat cagataagta
71161 tgaagagggt gcagtattag aatcgtgttg gccagacgtt cacgacactg gaaaatgcga
71221 tgttgattta ttcgactggt gtcaggggga tacgttcgat agaaacatat gccatcagtg
71281 gatcggttca gcctttaata ggagtgatag aactgtagag ggtcaacaat cgttaataaa
71341 tctgtataat aagatgcaaa cattatgtag taaagatgct agtgtaccaa tatgtgaatc
71401 atttttgcat catttacgcg cacacaatac agaagatagc aaagagatga tcgattatat
71461 tctaagacaa cagtctgcgg actttaaaca gaaatatatg agatgtagtt atcccactag
71521 agataagtta gaagagtcat taaaatatgc ggaacctcga gaatgttggg atccagagtg
71581 ttcgaatgcc aatgttaatt tcttactaac acgtaattat aataatttag gactttgcaa
71641 tattgtacga tgtaatacta gcgtgaacaa cttacagatg gataaaactt cctcattaag
71701 attgtcatgt ggattaagca atagtgatag attttctact gttcccgtca atagagcaaa
71761 agtagttcaa cataatatta aacattcgtt cgacctaaaa ttgcatttga tcagtttatt
```

FIG. 22 (CONT.)

```
71821 atctctcttg gtaatatgga tactaattgt agctatttaa atgggtgccg cggcaagcat
71881 acagacgacg gtgaatacac tcagcgaacg tatctcgtct aaattagaac aagaagcgaa
71941 cgctagtgct caaacaaaat gtgatataga aatcggaaat ttttatatcc gacaaaacca
72001 tggatgtaac ctcactgtta aaaatatgtg ctctgcggac gcggatgctc agttggatgc
72061 tgtgttatca gccgctacag aaacatatag tggattaaca ccggaacaaa aagcatacgt
72121 accagctatg tttactgctg cgttaaacat tcagacgagt gtaaacactg ttgttagaga
72181 ttttgaaaat tatgtgaaac agacttgtaa ttctagcgcg gtcgtcgata acaaattaaa
72241 gatacaaaac gtaatcatag atgaatgtta cggagcccca ggatctccaa caaatttgga
72301 atttattaat acaggatcta gcaaaggaaa ttgtgccatt aaagcgttga tgcaattgac
72361 gactaaggcc actactcaaa tagcacctag acaagttgct ggtacaggag ttcagtttta
72421 tatgattgtt atcggtgtta taatattggc agcgttgttt atgtactatg ccaagcgtat
72481 gttgttcaca tccaccaatg ataaaatcaa acttatttta gccaataagg aaaacgtcca
72541 ttggactact tacatggaca cattctttag aacttctccg atggttattg ctaccacgga
72601 tatgcaaaac tgaaaatata ttgataatat tttaatagat taacatggaa gttatcgctg
72661 atcgtctaga cgatatagtg aaacaaaata tagcggatga aaaatttgta gattttgtta
72721 tacacggtct agagcatcaa tgtcctgcta tacttcgacc attaattagg ttgtttattg
72781 atatactatt atttgttata gtaatttata tttttacggt acgtctagta agtagaaatt
72841 atcaaatgtt gttggcgttg gtggcgctag tcatcacatt aactattttt tattacttta
72901 tactataata gtactagact gacttctaac aaacatctca cctgccataa ataaatgctt
72961 gatattaaag tcttctattt ctaacactat tccatctgtg gaaaataata ctctgacatt
73021 atcgctaatt gacacatcgg tgagtgatat gcctataaag taataatctt ctttgggcac
```

FIG. 22 (CONT.)

```
73081 atataccagt gtaccaggtt ctaacaacct atttactggt gctcctgtag catacttttt
73141 ctttaccttg agaatatcca tcgtttgctt ggtcaatagc gatatgtgat tttttatcaa
73201 ccactcaaaa aagtaattgg agtgttcata tcctctacgg gctattgtct catggccgtg
73261 tatgaaattt aagtaacacg actgtggtag atttgttcta tagagccggt tgccgcaaat
73321 agatagaact accaatatgt ctgtacaaat gttaaacatt aattgattaa cagaaaaaac
73381 aatgttcgtt ctgggaatag aaaccagatc aaaacaaaat tcgttagaat atatgccacg
73441 tttatacatg gaatataaaa taactacagt ttgaaaaata acagtatcat ttaaacattt
73501 aacttgcggg gttaatttca caactttact gtttttaaac tgttcaaaat atagcatcga
73561 tccatgagaa atacgtttag ccgcctttaa tagaggaaat cccaccgcct ttctggatct
73621 caccaacgac gatagttctg accagcaact tatttcttca tcatccacct gttttaacat
73681 ataataggca ggagatagat atccgtcatt gcaatattcc ttttcgtagg cacacaatct
73741 aatattgata aaatctccat tctcttctct gcatttatta tcttgtttcg gtggctgatt
73801 aggctgtagt cttggtttag gctttggtat atcgttgttg aatctatttt ggtcattaaa
73861 tctttcattt cttcctggta tatttctatc acctcgtttg gttggatttt tgtctatatt
73921 atcgtttgta acatcggtac gggtattcat ttatcacaaa aaaaacttct ctaaatgagt
73981 ctactgctag aaaacctcat cgaagaagat accatatttt ttgcaggaag tatatctgag
74041 tatgatgatt tacaaatggt tattgccggc gcaaaatcca aatttccaag atctatgctt
74101 tctattttta atatagtacc tagaacgatg tcaaaatatg agttggagtt gattcataac
74161 gagaatatca caggggcaat gtttaccaca atgtataata taagaaacaa tttgggtcta
74221 ggagatgata aactaactat tgaagccatt gaaaactatt tcttggatcc taacaatgag
```

FIG. 22 (CONT.)

```
74281 gttatgcctc ttatcattaa taatacggat atgactgccg tcattcctaa aaaaagtggt
74341 aggagaaaga ataagaacat ggttattttc cgtcaaggat catcacctat cttgtgtatt
74401 ttcgaaactc gtaaaaagat taatatttat aaagaaaata tggaatccgc gtcgactgag
74461 tatacaccta tcggagacaa caaggctttg atatctaaat atgcgggaat taatgtcctg
74521 aatgtgtatt ctccttccac atccatgaga ttgaatgcca tttacggatt caccaataaa
74581 aataaactag agaaacttag tactaataag gaactagaat cgtatagttc tagccctctt
74641 caagaaccca ttaggttaaa tgattttctg ggactattgg aatgtgttaa aaagaatatt
74701 cctctaacag atattccgac aaaggattga ttactataaa tggagaatgt tcctaatgta
74761 tactttaatc ctgtgtttat agagcccacg tttaaacatt ctttattaag tgtttataaa
74821 cacagattaa tagttttatt tgaagtattc attgtattca ttctaatata tgtatttttt
74881 agatctgaat taaatatgtt cttcatgcct aaacgaaaaa tacccgatcc tattgataga
74941 ttacgacgtg ctaatctagc gtgtgaagac gataaattaa tgatctatgg attaccatgg
75001 atgacaactc aaacatctgc gttatcaata aatagtaaac cgatagtgta taaagattgt
75061 gcaaagcttt tgcgatcaat aaatggatca caaccagtat ctcttaacga tgttcttcgc
75121 agatgatgat tcatttttta agtatttggc tagtcaagat gatgaatctt cattatctga
75181 tatattgcaa atcactcaat atctagactt tctgttatta ttattgatcc aatcaaaaaa
75241 taaattagaa gccgtgggtc attgttatga atctctttca gaggaataca gacaattgac
75301 aaaattcaca gactttcaag attttaaaaa actgtttaac aaggtcccta ttgttacaga
75361 tggaagggtc aaacttaata aaggatattt gttcgacttt gtgattagtt tgatgcgatt
75421 caaaaaagaa tcctctctag ctaccaccgc aatagatcct attagataca tagatcctcg
75481 tcgcgatatc gcattttcta acgtgatgga tatattaaag tcgaataaag tgaacaataa
```

FIG. 22 (CONT.)

75541 ttaattcttt attgtcatca tgaacggcgg acatattcag ttgataatcg gccccatgtt
75601 ttcaggtaaa agtacagaat taattagacg agttagacgt tatcaaatag ctcaatataa
75661 atgcgtgact ataaaatatt ctaacgataa tagatacgga acgggactat ggacgcatga
75721 taagaataat tttgaagcat tggaagcaac taaactatgt gatgtcttgg aatcaattac
75781 agatttctcc gtgataggta tcgatgaagg acagttcttt ccagacattg ttgaattctg
75841 tgagcgtatg gcaaacgaag gaaaaatagt tatagtagcc gcactcgatg ggacatttca
75901 acgtaaaccg tttaataata ttttgaatct tattccatta tctgaaatgg tggtaaaact
75961 aactgctgtg tgtatgaaat gctttaagga ggcttccttt tctaaacgat tgggtgagga
76021 aaccgagata gagataatag gaggtaatga tatgtatcaa tcggtgtgta gaaagtgtta
76081 cgtcggctca taatattata ttttttatct aaaaaactaa aaataaacat tgattaaatt
76141 ttaatataat acttaaaaat ggatgttgtg tcgttagata aaccgtttat gtattttgag
76201 gaaattgata atgagttaga ttacgaacca gaaagtgcaa atgaggtcgc aaaaaaactg
76261 ccgtatcaag gacagttaaa actattacta ggagaattat tttttcttag taagttacag
76321 cgacacggta tattagatgg tgccaccgta gtgtatatag gatctgctcc cggtacacat
76381 atacgttatt tgagagatca tttctataat ttaggagtga tcatcaaatg gatgctaatt
76441 gacggccgcc atcatgatcc tattttaaat ggattgcgtg atgtgactct agtgactcgg
76501 ttcgttgatg aggaatatct acgatccatc aaaaaacaac tgcatccttc taagattatt
76561 ttaatttctg atgtgagatc caaacgagga ggaaatgaac ctagtacggc ggatttacta
76621 agtaattacg ctctacaaaa tgtcatgatt agtattttaa accccgtggc gtctagtctt
76681 aaatggagat gcccgtttcc agatcaatgg atcaaggact tttatatccc acacggtaat
76741 aaaatgttac aaccttttgc tccttcatat tcagctgaaa tgagattatt aagtatttat

FIG. 22 (CONT.)

```
76801 accggtgaga acatgagact gactcgagtt accaaatcag acgctgtaaa ttatgaaaaa
76861 aagatgtact accttaataa gatcgtccgt aacaaagtag ttgttaactt tgattatcct
76921 aatcaggaat atgactattt tcacatgtac tttatgctga ggaccgtgta ctgcaataaa
76981 acatttccta ctactaaagc aaaggtacta tttctacaac aatctatatt tcgtttctta
77041 aatattccaa caacatcaac tgaaaaagtt agtcatgaac caatacaacg taaaatatct
77101 agcaaaaatt ctatgtctaa aaacagaaat agcaagagat ccgtacgcag taataaatag
77161 aaacgtacta ctgagatata ctaccgatat agagtataat gatttagtta ctttaataac
77221 cgttagacat aaaattgatt ctatgaaaac tgtgtttcag gtatttaacg aatcatccat
77281 aaattatact ccggttgatg atgattatgg agaaccaatc attataacat cgtatcttca
77341 aaaaggtcat aacaagtttc ctgtaaattt tctatacata gatgtggtaa tatctgactt
77401 atttcctagc tttgttagac tagatactac agaaactaat atagttaata gtgtactaca
77461 aacaggcgat ggtaaaaaga ctcttcgtct tcccaaaatg ttagagacgg aaatagttgt
77521 caagattctc taccgtccta atataccatt aaaaattgtt agatttttcc gcaataacat
77581 ggtaactgga gtagagatag ccgatagatc tgttatttca gtcgctgatt aatcaattag
77641 tagagatgag ataagaacat tataataatc aataatatat tttatatctt atatcttgtt
77701 tagaaaaatg ctaatattaa aatagctaac gctagtaatc caatcggaag ccatttgata
77761 tctataatag ggtatctaat ttcctgattc agatagcgga cagctatatt ctcggtagct
77821 actcgtttgg aatcacaaac attatttaca tctaatttac tatctgtaat ggaaacgttt
77881 cccaatgaaa tggtacaatc cgatacattg catttgttta tatttttttt taaagaggct
77941 ggtaacaacg catcgcttcg tttacatggc tcgtaccaac aataataggg taatcttgta
```

FIG. 22 (CONT.)

```
78001 tctattccta tccgtactat gcttttatca ggataaatac atttacatcg tatatcgtct
78061 ttgttagcat cacagaatgc ataaatttgt tcgtccgtca tgataaaaat ttaaagtgta
78121 aatataacta ttattttata gttgtaataa aaagggaaat ttgattgtat actttcggtt
78181 ctttaaaaga aactgacttg ataaaaatgg ctgtaatctc taaggttacg tatagtctat
78241 atgatcaaaa agagattaat gctacagata ttatcattag tcatgttaaa aatgacgacg
78301 atatcggtac cgttaaagat ggtagactag gtgctatgga tggggcatta tgtaaaactt
78361 gtgggaaaac ggaattggaa tgtttcggtc actggggtaa agtaagtatt tataaaactc
78421 atatagttaa gcctgaattt atttcagaaa ttattcgttt actgaattat atatgtattc
78481 actgcggatt attgcgttca cgagaaccgt attccgacga tattaaccta aaagagttat
78541 cgggacacgc tcttaggaga ttaaaggata aaatattatc caagaaaaag tcatgttgga
78601 acagtgaatg tatgcaaccg tatcaaaaaa ttacttttc aaagaaaaag gtttgtttcg
78661 tcaacaagtt ggatgatatt aacgttccta attctctcat ctatcaaaag ttaatttcta
78721 ttcatgaaaa gttttggcca ttattagaaa ttcatcaata tccagctaac ttattttata
78781 cagactactt tcccatccct ccgttgatta ttagaccggc tattagtttt tggatagata
78841 gtatacccaa agaaaccaat gaattaactt acttattagg tatgatcgtt aagaattgta
78901 acttgaatgc tgatgaacag gttatccaga aggcggtaat agaatacgat gatattaaaa
78961 ttatttctaa taacacttcc agtatcaatt tatcatatat cacatccggc aaaaataata
79021 tgattagaag ttatatcgtc gcccggcgaa aagatcagac cgctagatct gtaattggtc
79081 ccagtacatc tatcaccgtt aatgaggtag gaatgcccgc atatattaga aatacactta
79141 cagaaaagat atttgttaat gcctttacag tggataaagt taaacaacta ttagcgtcaa
79201 accaagttaa attttacttt aataaacgat taaaccaatt aacaagaata cgccaaggaa
```

FIG. 22 (CONT.)

```
79261 agtttatcaa aaataaaata catttattgc ctggtgattg ggtagaagta gctgttcaag
79321 aatatacaag tattattttt ggaagacagc cgtctctaca tagatacaac gtcatcgctt
79381 catctatcag agctaccgaa ggagatacta tcaaaatatc tcccggaatt gtcaactctc
79441 aaaatgctga tttcgacgga gatgaagaat ggatgatatt ggagcaaaat cctaaagccg
79501 taattgaaca aagtattctt atgtatccga cgacgttact caaacacgat attcatggag
79561 cccccgttta tggatctatt caagatgaaa tcgtagcagc gtattcattg tttaggatac
79621 aagatctttg tttagatgaa gtattgaaca tcttggggaa atatggaaga gagttcgatc
79681 ctaaaggtaa atgtaaattc agcggtaaag atatctatac ttacttgata ggtgaaaaga
79741 ttaattatcc gggtctctta aaggatggtg aaattattgc aaacgacgta gatagtaatt
79801 ttgttgtggc tatgaggcat ctgtcattgg ctggactctt atccgatcat aagtcgaacg
79861 tggaaggtat caactttatt atcaagtcat cttatgtttt taagagatat ctatctattt
79921 acggttttgg ggtgacattc aaagatctga gaccaaattc gacgttcact aataaattgg
79981 aggccatcaa cgtagaaaaa atagaactta tcaaagaagc atacgccaaa tatctcaacg
80041 atgtaagaga cgggaaaata gttccattat ctaaagcttt agaggcggac tatgtggaat
80101 ccatgttatc caacttgaca aatcttaata tccgagagat agaagaacat atgagacaaa
80161 cgctgataga tgatccagat aataacctcc tgaaaatggc caaagcgggt tataaagtaa
80221 atcccacaga actaatgtat attctaggta cttatggaca acagaggatt gatggtgaac
80281 cagcagagac tcgagtattg ggtagagtct taccttacta tcttccagac tctaaggatc
80341 cagaaggaag aggttacatt cttaattctt taacaaaagg attaacgggt tctcaatatt
80401 acttttcgat gctggttgca agatctcaat ctactgatat cgtctgtgaa acatcacgta
80461 ccggaacact ggctagaaaa atcattaaaa agatggagga tatggtggtc gacggatacg
```

FIG. 22 (CONT.)

```
80521 gacaagtagt tataggtaat acgctcatca agtacgccgc caattatacc aaaattctag
80581 gctcagtatg taaacctgta gatcttatct atccagatga gtccatgact tggtatttgg
80641 aaattagtgc tctgtggaat aaaataaaac agggattcgt ttactctcag aaacagaaac
80701 ttgcaaaaaa gacattggcg ccgtttaatt tcctagtatt cgtcaaaccc accactgagg
80761 ataatgctat taaggttaag gatctgtacg atatgattca taacgtcatt gatgatgtga
80821 gagagaaata cttctttacg gtatctaata tagattttat ggagtatata ttcttgacgc
80881 atcttaatcc ttctagaatt agaattacaa aagaaacggc tatcactatc tttgaaaagt
80941 tctatgaaaa actcaattat actctaggtg gtggaactcc tattggaatt atttctgcac
81001 aggtattgtc tgagaagttt acacaacaag ccctgtccag ttttcacact actgaaaaaa
81061 gtggtgccgt caaacaaaaa cttggtttca acgagtttaa taacttgact aatttgagta
81121 agaataagac cgaaattatc actctggtat ccgatgatat ctctaaactt caatctgtta
81181 agattaattt cgaatttgta tgtttgggag aattaaatcc aaacatcact cttcgaaaag
81241 aaacagatag gtatgtagta gatataatag tcaatagatt atacatcaag agagcagaaa
81301 ttaccgaatt agtcgtcgaa tatatgattg aacgattcat ctcctttagc gtcattgtaa
81361 aggaatgggg tatggaaaca ttcattgagg atgaggataa tattagattt actgtctacc
81421 taaatttcgt tgaaccggaa gaattgaatc ttagtaagtt tatgatggtt cttccgggtg
81481 ccgccaacaa gggcaagatt agtaaattca agattcctat ctctgattat acgggatatg
81541 acgacttcaa tcaaacaaaa aagctcaata agatgactgt agaactcatg aatctaaaag
81601 aattgggttc tttcgatttg gaaaacgtca acgtgtatcc tggagtatgg aatacatacg
81661 atatcttcgg tatcgaggcc gctcgtgaat acttgtgcga agccatgtta aacacctatg
```

FIG. 22 (CONT.)

```
81721 gagaagggtt cgattatctg tatcagcctt gtgatcttct cgctagttta ctatgtgcta
81781 gttacgaacc agaatcagtg aataaattca agttcggcgc agctagtact cttaagagag
81841 ctacgttcgg agacaataaa gcattgttaa acgcggctct tcataaaaag tcagaaccta
81901 ttaacgataa tagtagctgc cactttttta gcaaggtccc taatatagga actggatatt
81961 acaaatactt tatcgacttg ggtcttctca tgagaatgga aaggaaacta tctgataaga
82021 tatcttctca aaagatcaag gaaatggaag aaacagaaga cttttaattc ttatcaataa
82081 catatttttc tatgatctgt cttttaaacg atggattttc cacaaatgcg cctctcaagt
82141 ccctcataga atgatacacg tataaaaaat atagcatagg caatgactcc ttatttttag
82201 acattagata tgccaaaatc atagccccgc ttctatttac tcccgcagca caatgaacca
82261 acacgggctc gtttcgttga tcacatttag ataaaaaggc ggttacgtcg tcaaaatatt
82321 tactaatatc ggtagttgta tcatctacca acggtatatg aataatatta atattagagt
82381 taggtaatgt atatttatcc atcgtcaaat ttaaaacata tttgaactta acttcagatg
82441 atggtgcatc catagcattt ttataatttc ccaaatacac attattggtt actcttgtca
82501 ttatagtggg agatttggct ttgtgcatat ctccagttga acgtagtagt aagtatttat
82561 acaaactttt cttatccatt tataacgtac aaatggataa aactacttta tcggtaaacg
82621 cgtgtaattt agaatacgtt agagaaaagg ctatagtagg cgtacaagca gccaaaacat
82681 caacacttat attctttgtt attatattgg caattagtgc gctattactc tggtttcaga
82741 cgtctgataa tccagtcttt aatgaattaa cgagatatat gcgaattaaa aatacggtta
82801 acgattggaa atcattaacg gatagcaaaa caaaattaga aagtgataga ggtagacttc
82861 tagccgctgg taaggatgat atattcgaat tcaaatgtgt ggatttcggc gcctatttta
82921 tagctatgcg attggataag aaaacatatc tgccgcaagc tattaggcga ggtactggag
```

FIG. 22 (CONT.)

```
82981 acgcgtggat ggttaaaaag gcggcaaagg tcgatccatc tgctcaacaa ttttgtcagt
83041 atttgataaa acacaagtct aataatgtta ttacttgtgg taatgagatg ttaaatgaat
83101 taggttatag cggttatttt atgtcaccgc attggtgttc cgattttagt aatatggaat
83161 agtgttagat aaatgcggta acgaatgttc ctgtaaggaa ccataacagc ttagatttaa
83221 cgttaaagat gagcataaac ataataaaca aaattacaat caaacctata acattaatat
83281 caaacaatcc aaaaaatgaa atcagtggag tagtaaacgc gtacataact cctggataac
83341 gtttagcagc tgccgttcct attctagacc aaaaattcgg tttcatgttt tcgaaacggt
83401 attctgcaac aagtcgagga tcgtgttcta catatttggc ggcgttatcc agtatctgcc
83461 tattgatctt catttcgttt tcgattctgg ctatttcaaa ataaaatccc gatgatagac
83521 ctccagactt tataatttca tctacgatgt tcagcgccgt agtaactcta ataatatagg
83581 ctgataagct aacatcatac cctcctgtat atgtgaatat ggcatgattt ttgtccatta
83641 caagctcggt tttaacttta ttgcctgtaa taatttctct catctgtagg atatctattt
83701 ttttgtcatg cattgccttc aagacgggac gaagaaacgt aatatcctca ataacgttat
83761 cgttttctac aataactaca tattctacct ttttattttc taactcggta aaaaaattag
83821 aatcccatag ggctaaatgt ctagcgatat ttcttttcgt ttcctctgta cacatagtgt
83881 tacaaaaccc tgaaaagaag tgagtatact tgtcatcatt tctaatgttt cctccagtcc
83941 actgtataaa cgcataatcc ttgtaatgat ctggatcatc cttgactacc acaacatttc
84001 tttttctgg cataacttca ttgtccttta catcatcgaa cttctgatca ttaatatgct
84061 catgaacatt aggaaatgtt tctgatggag gtctatcaat aactggcaca acaataacag
84121 gagttttcac cgccgccatt tagttattga aattaatcat atacaactct ttaatacgag
84181 ttatattttc gtctatccat tgtttcacat ttacatattt cgacaaaaag atataaaatg
```

FIG. 22 (CONT.)

```
84241 cgtattccaa tgcttctctg tttaatgaat tactaaaata tacaaacacg tcactgtctg
84301 gcaataaatg atatcttaga atattgtaac aatttatttt gtattgcaca tgttcgtgat
84361 ctatgagttc ttcttcgaat ggcataggat ctccgaatct gaaaacgtat aaataggagt
84421 tagaataata atatttgaga gtattggtaa tatataaact ctttagcggt ataattagtt
84481 tttttctctc gatttctatt tttagatgtg atggaaaaat gactaatttt gtagcattag
84541 tatcatgaac tctaatcgag atcttaatat cttcgtcaca cgttagttct ttgaagtttt
84601 taagagatgc atcagttggt tcgaccgatg gagtaggtgc aacaattttt tgttcgatgt
84661 atgtatgtac tggagccatt gtcttaacta taatggtgct tgtatcgaaa aactttaatg
84721 cagataatgg aagctcttcg ccgcgacttt ctacatcgta attgggttct aacgccgatc
84781 tctgaatgga tactagtttt ctaagttcta atgtgattct ctgaaaatgt aaatccaatt
84841 cctccggcat tatagatgtg tatacatcgg taaataaaac tatagtatcc aacgatccct
84901 tctcgcaaat tctagtctta accaaaaaat cgtatataac cacggagatg gcgtatttaa
84961 gagtggattc ttctaccgtt ttgttcttgg atttcatata agaaactata aagtccgcac
85021 tactgttaag aatgattact aacgcaacta tatagtttaa attaagcatc ttggaaacat
85081 aaaataactc tgtagacgat acttgacttt cgaataagtt tgcagacaaa cgaagaaaga
85141 acagacctct cttaatttca gaagaaaact tttttcgta ttcctgacgt ctagagttta
85201 tatcaataag aaagttaaga attagtcggt taatgttgta tttcattacc caagtttgag
85261 atttcataat attatcaaaa gacatgataa tattaaagat aaagcgctga ctatgaacga
85321 aatagctata tggttcgctc aagaatatag tcttgttaaa cgtggaaacg ataactgtat
85381 ttttaatcac gtcagcggca tctaaattaa atataggtat atttattcca cacactctac
```

FIG. 22 (CONT.)

```
85441 aatatgccac accatcttca taataaataa attcgttagc aaaattatta attttagtga
85501 aatagttagc gtcaactttc atagcttcct tcaatctaat ttgatgctca cacggtgcga
85561 attccactct aacatccctt ttccatgcct caggttcatc gatctctata atatctagtt
85621 ttttgcgttt cacaaacaca ggctcgtctc tcgcgatgag atctgtatag taactatgta
85681 aatgataact agatagaaag atgtagctat atagatgacg atcctttaag agaggtatga
85741 tgactttacc ccaatcagat agactgttgt tatggtcttc ggaaaaagaa tttttataaa
85801 tttttccagt attttccaaa tatacgtact taacatctaa aaaatcctta atgataatag
85861 gaatggataa tccgtctatt ttataaagaa atacatatcg cacattatac tttttttttgg
85921 aaatgggaat accgatgtgt ctacataaat atgcaaagtc taaatatttt ttagagaatc
85981 ttagttggtc caaattcttt tccaagtacg gtaatagatt tttcatattg aacggtatct
86041 tcttaatctc tggttctagt tccgcattaa atgatgaaac taagtcacta ttttttataac
86101 taacgattac atcacctcta acatcatcat ttaccagaat actgatcttc ttttgtcgta
86161 aatacatgtc taatgtgtta aaaaaaagat catacaagtt atacgtcatt tcatctgtgg
86221 tattcttgtc attgaaggat aaactcgtac taatctcttc tttaacagcc tgttcaaatt
86281 tatatcctat atacgaaaaa atagcaacca gtgtttgatc atccgcgtca atattctgtt
86341 ctatcgtagt gtataacaat cgtatatctt cttctgtgat agtcgatacg ttataaaggt
86401 tgataacgaa aatattttta tttcgtgaga taaagtcatc gtaggatttt ggacttatat
86461 tcgcgtctag tagatatgct tttatttttg gaatgatctc aattagaata gtctctttag
86521 agtccattta aagttacaaa caactaggaa attggtttat gatgtataat tttttttagtt
86581 tttatagatt ctttattcta tacttaaaaa atgaaaataa atacaaaggt tcttgagggt
86641 tgtgttaaat tgaaagcgag aaataatcat aaattatttc attatcgcga tatccgttaa
```

FIG. 22 (CONT.)

86701 gtttgtatcg taatggcgtg gtcaattaca aataaagcgg atactagtag cttcacaaag
86761 atggctgaaa tcagagctca tctaaaaaat agcgctgaaa ataaagataa aaacgaggat
86821 attttcccgg aagatgtaat aattccatct actaagccca aaaccaaacg agccactact
86881 cctcgtaaac cagcggctac taaaagatca accaaaaagg aggaagtgga agaagaagta
86941 gttatagagg aatatcatca aacaactgaa aaaaattctc catctcctgg agtcagcgac
87001 attgtagaaa gcgtggctgc tgtagagctc gatgatagcg acggggatga tgaacctatg
87061 gtacaagttg aagctggtaa agtaaatcat agtgctagaa gcgatctttc tgacctaaag
87121 gtggctaccg acaatatcgt taaagatctt aagaaaatta ttactagaat ctctgcagta
87181 tcgacggttc tagaggatgt tcaagcagct ggtatctcta gacaatttac ttctatgact
87241 aaagctatta caacactatc tgatctagtc accgagggaa aatctaaagt tgttcgtaaa
87301 aaagttaaaa cttgtaagaa gtaaatgcgt gcactttttt ataaagatgg taaactcttt
87361 accgataata atttttttaaa tcctgtatca gacgataatc cagcgtatga ggttttgcaa
87421 catgttaaaa ttcctactca tttaacagat gtagtagtat atgaacaaac gtgggaggag
87481 gcgttaacta gattaatttt tgtgggaagt gattcaaaag gacgtagaca atacttttac
87541 ggaaaaatgc atgtacagaa tcgcaacgct aaaagagatc gtatttttgt tagagtatat
87601 aacgttatga aacgaattaa ttgttttata aacaaaaata taaagaaatc gtccacagat
87661 tccaattatc agttggcggt ttttatgtta atggaaacta tgttttttat tagatttggt
87721 aaaatgaaat atcttaagga gaatgaaaca gtagggttat taacactaaa aaataaacac
87781 atagaaataa gtcccgatga aatagttatc aagtttgtag gaaaggacaa agtttcacat
87841 gaatttgttg ttcataagtc taatagacta tataaaccgc tattgaaact gacggatgat
87901 tctagtcccg aagaatttct gttcaacaaa ctaagtgaac gaaaggtata cgaatgtatc

FIG. 22 (CONT.)

```
87961 aaacagtttg gtattagaat caaggatctc cgaacgtatg gagtcaatta tacgttttta
88021 tataattttt ggacaaatgt aaagtccata tctcctcttc cgtcaccaaa aaagttaata
88081 gcgttaacta tcaaacaaac tgctgaagtg gtaggtcata ctccatcaat ttcaaaaaga
88141 gcttatatgg caacgactat tttagaaatg gtaaaggata aaaatttttt agatgtagta
88201 tctaaaacta cgttcgatga attcctatct atagtcgtag atcacgttaa atcatctacg
88261 gatggatgat atagatcttt acacaaataa ttacaagacc gataaatgga aatggataag
88321 cgtatgaaat ctctcgcaat gacagctttc ttcggagagc taaacacatt agatattatg
88381 gcattgataa tgtctatatt taaacgccat ccaaacaata ccattttttc agtggataag
88441 gatggtcagt ttatgattga tttcgaatac gataattata aggcttctca atatttggat
88501 ctgaccctca ctccgatatc tggagatgaa tgcaagactc acgcatcgag tatagccgaa
88561 caattggcgt gtgtggatat tattaaagag gatattagcg aatatatcaa aactactccc
88621 cgtcttaaac gatttataaa aaaataccgc aatagatcag atactcgtat cagtcgagat
88681 acagaaaagc ttaaaatagc tctagctaaa ggcatagatt acgaatatat aaaagacgct
88741 tgttaataag taaatgaaaa aaaactagtc gtttataata aaacacaata tggatgccaa
88801 catagtatca tcttctacta ttgcaacgta tatagacgct ttagcgaaga atgcttcaga
88861 attagaacag aggtctaccg catacgaaat aaataatgaa ttggaactag tatttattaa
88921 gccgccatta attactttga caaatgtagt gaatatctct acgattcagg aatcgtttat
88981 tcgatttacc gttactaata aggaaggtgt taaaattaga actaagattc cattatctaa
89041 ggtacatggt ctagatgtaa aaaatgtaca gttagtagat gctatagata acatagtttg
89101 ggaaaagaaa tcattagtga cggaaaatcg tcttcacaaa gaatgcttgt tgagactatc
```

FIG. 22 (CONT.)

```
89161 gacagaggaa cgtcatatat ttttggatta caagaaatat ggatcctcta tccgactaga
89221 attagtcaat cttattcaag caaaaacaaa aaactttacg atagacttta agctaaaata
89281 ttttctagga tccggtgccc agtctaaaag ttctttatta cacgctatta atcatccaaa
89341 gtcaaggcct aatacatctc tggaaataga attcacacct agagacaatg aaaaagttcc
89401 atatgatgaa ctaataaagg aattgacgac tctatcacgt catatattta tggcttctcc
89461 agagaatgta attctttctc cgcctattaa cgcgcctata aaaaccttta tgttgcctaa
89521 acaagatata gtaggtttgg atctggaaaa tctatatgcc gtaactaaga ctgacggaat
89581 tcctataact atcagagtta catcaaaagg gttgtattgt tattttacac atcttggtta
89641 tattattaga tatcctgtta agagaataat agattccgaa gtagtagtct ttggtgaggc
89701 agttaaggat aagaactgga ccgtatatct cattaagcta atagagcctg tgaatgcaat
89761 caatgataga ctagaagaaa gtaagtatgt tgaatctaaa ctagtggata tttgtgatcg
89821 gatagtattc aagtcaaaga aatacgaagg tccgtttact acaactagtg aagtcgtcga
89881 tatgttatct acatatttac caaagcaacc agaaggtgtt attctgttct attcaaaggg
89941 acctaaatct aacattgatt ttaaaattaa aaaggaaaat actatagacc aaactgcaaa
90001 tgtagtattt aggtacatgt ccagtgaacc aattatcttt ggagaatcgt ctatctttgt
90061 agagtataag aaatttagca acgataaagg ctttcctaaa gaatatggtt ctggtaagat
90121 tgtgttatat aacggcgtta attatctaaa taatatctat tgtttggaat atattaatac
90181 acataatgaa gtgggtatta agtccgtggt tgtacctatt aagtttatag cagaattctt
90241 agttaatgga gaaatactta aacctagaat tgataaaacc atgaaatata ttaactcaga
90301 agattattat ggaaatcaac ataatatcat agtcgaacat ttaagagatc aaagcatcaa
90361 aataggagat atctttaacg aggataaact atcggatgtg ggacatcaat acgccaataa
```

FIG. 22 (CONT.)

```
90421 tgataaattt agattaaatc cagaagttag ttattttacg aataaacgaa ctagaggacc
90481 gttgggaatt ttatcaaact acgtcaagac tcttcttatt tctatgtatt gttccaaaac
90541 atttttagac gattccaaca aacgaaaggt attggcgatt gattttggaa acggtgcgga
90601 cctggaaaaa tacttttatg gagagattgc gttattggta gcgacggatc cggatgctga
90661 tgctatagct agaggaaatg aaagatacaa caaattaaac tctggaatta aaaccaagta
90721 ctacaaattt gactacattc aggaaactat tcgatccgat acatttgtct ctagtgtcag
90781 agaagtattc tattttggaa agtttaatat catcgactgg cagtttgcta tccattattc
90841 ttttcatccg agacattatg ctaccgtcat gaataactta tccgaactaa ctgcttctgg
90901 aggcaaggta ttaatcacta ccatggacgg agacaaatta tcaaaattaa cagataaaaa
90961 gacttttata attcataaga atttacctag tagcgaaaac tatatgtctg tagaaaaaat
91021 agctgatgat agaatagtgg tatataatcc atcaacaatg tctactccaa tgactgaata
91081 cattatcaaa aagaacgata tagtcagagt gtttaacgaa tacggatttg ttcttgtaga
91141 taacgttgat ttcgctacaa ttatagaacg aagtaaaaag tttattaatg gcgcatctac
91201 aatggaagat agaccgtcta caaaaaactt tttcgaacta aatagaggag ccattaaatg
91261 tgaaggttta gatgtcgaag acttacttag ttactatgtt gtttatgtct tttctaagcg
91321 gtaaataata atatggtatg ggttctgata tccccgttct aaatgcatta aataattcca
91381 atagagcgat ttttgttcct ataggacctt ccaactgtgg atactctgta ttgttaatag
91441 atatattaat acttttgtcg ggtaacagag gttctacgtc ttctaaaaat aaaagtttga
91501 taacatctgg cctgttcata aataaaaact tggcgattct atatatactc ttattatcaa
91561 atctagccat tgtcttatag atgtgagcta ctgtaggtgt accatttgat tttctttcta
91621 atactatata tttctctcga agaagttctt gcacatcatc tgggaataaa atactactgt
```

FIG. 22 (CONT.)

```
91681 tgagtaaatc agttattttt tttatatcga tattgatgga catttttata gttaaggata
91741 ataagtatcc caaagtcgat aacgacgata acgaagtatt tatactttta ggaaatcaca
91801 atgactttat cagatcaaaa ttaacaaaat taaaggagca tgtatttttt tctgaatata
91861 ttgtgactcc agatacatat ggatctttat gcgtcgaatt aaatgggtct agttttcagc
91921 acggtggtag atatatagag gtggaggaat ttatagatgc tggaagacaa gttagatggt
91981 gttctacatc caatcatata tctgaagata tgcacactga taaatttgtc atttatgata
92041 tttatacgtt tgattcgttc aagaataaac gattggtatt tgtacaggtg cctccatcat
92101 taggagatga tagctatttg actaatccgt tattgtctcc gtattatcgt aattcagtag
92161 ccagacaaat ggtcaatgat atgattttta atcaagattc atttttaaaa tatttattag
92221 aacatctgat tagaagccac tatagagttt ctaaacatat aacaatagtt agatacaagg
92281 ataccgaaga attaaatcta acgagaatat gttataatag agataagttt aaggcgtttg
92341 tattcgcttg gtttaacggc gtttcggaaa atgaaaaggt actagatacg tataaaaagg
92401 tatctaattt gatataatga attcagtgac tgtatcacac gcgccatata ctattactta
92461 tcacgatgat tgggaaccag taatgagtca attggtagag ttttataacg aagtagccag
92521 ttggctgcta cgagacgaga cgtcgcctat tcctgataag ttctttatac agttgaaaca
92581 accgcttaga aataaacgag tatgtgtgtg tggtatagat ccgtatccga aagatggaac
92641 tggtgtaccg ttcgaatcac caaattttac aaaaaaatca attaaggaga tagcttcatc
92701 tatatctaga ttaaccggag taattgatta taaaggttat aaccttaata taatagacgg
92761 ggttataccc tggaattatt acttaagttg taaattagga gaaacaaaaa gtcacgcgat
92821 ctactgggat aagatttcca agttactgct gcagcatata actaaacacg ttagtgttct
```

FIG. 22 (CONT.)

```
92881 ttattgtttg ggtaaaacag atttctcgaa tatacgggca aagttagaat ccccggtaac
92941 taccatagtc ggatatcatc cagcggctag agaccgccaa ttcgagaaag atagatcatt
93001 tgaaattatc aacgttttac tggaattaga caacaaggca cctataaatt gggctcaagg
93061 gtttatttat taatgcttta gtgaaatttt aacttgtgtt ctaaatggat gcaactatta
93121 gaggtaatga tgttatcttt gttcttaaga ctataggtgt cccgtcagcg tgcagacaaa
93181 atgaagatcc aagatttgta gaagcattta aatgcgacga gttagaaaga tatattgaga
93241 ataatccaga atgtacacta ttcgaaagtc ttagggatga ggaagcatac tctatagtca
93301 gaattttcat ggatgtagat ttagacgcgt gtctagacga aatagattat ttaacggcta
93361 ttcaagattt tattatcgag gtgtcaaact gtgtagctag attcgcgttt acagaatgcg
93421 gtgccattca tgaaaatgta ataaaatcca tgagatctaa tttttcattg actaagtcta
93481 caaatagaga taaaacaagt tttcatatta tctttttaga cacgtatacc actatggata
93541 cattgatagc tatgaaacga acactattag aattaagtag atcatctgaa aatccactaa
93601 ccagatcgat agacactgcc gtatatagga gaaaaacaac tcttcgggtt gtaggtacta
93661 ggaaaaatcc aaattgcgac actattcatg taatgcaacc accgcatgat aatatagaag
93721 attacctatt cacttacgtg gatatgaaca acaatagtta ttacttttct ctacaacgac
93781 gattggagga tttagttcct gataagttat gggaaccagg gtttatttca ttcgaagacg
93841 ctataaaaag agtttcaaaa atattcatta attctataat aaactttaat gatctcgatg
93901 aaaataattt tacaacggta ccactggtca tagattacgt aacaccttgt gcattatgta
93961 aaaaacgatc gcataaacat ccgcatcaac tatcgttgga aaatggtgct attagaattt
94021 acaaaactgg taatccacat agttgtaaag ttaaaattgt tccgttggat ggtaataaac
94081 tgtttaatat tgcacaaaga attttagaca ctaactctgt tttattaacc gaacgaggag
```

FIG. 22 (CONT.)

```
94141 accatatagt ttggattaat aattcatgga aatttaacag cgaagaaccc ttgataacaa
94201 aactaattct gtcaataaga catcaactac ctaaggaata ttcaagcgaa ttactctgtc
94261 cgaggaaacg aaagactgta gaagctaaca tacgagacat gttaatagat tcagtggaga
94321 ccgataccta tccggataaa cttccgttta aaaatggtgt attggacctg gtagacggaa
94381 tgttttactc tggagatgat gctaaaaaat atacgtgtac tgtatcaacc ggatttaaat
94441 ttgacgatac aaagttcgtc gaagacagtc cagaaatgga agagttaatg aatatcatta
94501 acgatatcca accattaacg gatgaaaata agaaaaatag agagttgtac gaaaaaactt
94561 tatctagttg tttatgcggt gctaccaaag gatgtttaac attctttttt ggagaaactg
94621 caactggaaa gtcgacaacc aaacgtttgt taaagtctgc tatcggtgac ctgtttgttg
94681 agacgggtca aacaatttta acagatgtat tggataaagg acctaatcca tttatcgcta
94741 acatgcattt gaaaagatct gtattctgta gcgaactacc tgattttgcc tgtagtggat
94801 caaagaaaat tagatctgac aatattaaaa agttgacaga accttgtgtc attggaagac
94861 cgtgtttctc caataaaatt aataatagaa accatgcgac aatcattatc gatactaatt
94921 acaaacctgt ctttgatagg atagataacg cattaatgag aagaattgcc gtcgtgcgat
94981 tcagaacaca cttttctcaa ccttctggta gagaggctgc tgaaaataat gacgcgtacg
95041 ataaagtcaa actattagac gaggggttag atggtaaaat acaaaataat agatatagat
95101 tcgcatttct atacttgttg gtgaaatggt acaaaaaata tcatgttcct attatgaaac
95161 tatatcctac accggaagag attccggact ttgcattcta tctcaaaata ggtactctgt
95221 tagtatctag ctctgtaaag catattccat taatgacgga cctctccaaa aagggatata
95281 tattgtacga taatgtggtt actcttccgt tgactacttt ccaacagaaa atatccaagt
95341 attttaattc tagactattt ggacacgata tagagagctt catcaataga cataagaaat
```

FIG. 22 (CONT.)

```
95401 ttgccaatgt tagtgatgaa tatctgcaat atatattcat agaggatatt tcatctccgt
95461 aaatatatgc tcatatattt atagaagata tcacatatct aaatgaatac cggaatcata
95521 gatttatttg ataatcatgt tgatagtata ccaactatat tacctcatca gttagctact
95581 ctagattatc tagttagaac tatcatagat gagaacagaa gcgtgttatt gttccatatt
95641 atgggatcag gtaaaacaat aatcgctttg ttgttcgcct tggtagcttc cagatttaaa
95701 aaggtttaca ttctagtgcc taatattaac attttgaaaa tttttaatta taatatgggt
95761 gtagctatga acttgtttaa tgacgaattc atagctgaga atatctttat tcattccaca
95821 acaagttttt attctcttaa ttataacgat aacgtcatta attataacgg attatctcgc
95881 tacaataact ctatttttat cgttgatgag gcacataata tctttgggaa taatactgga
95941 gaacttatga ccgtgataaa aaataaaaac aagattcctt ttttactatt gtctggatct
96001 cccattacta acacacctaa tactctgggt catattatag atttaatgtc cgaagagacg
96061 atagattttg gtgaaattat tagtcgtggt aagaaagtaa ttcagacact tcttaacgaa
96121 cgaggtgtga atgtacttaa ggatttgctt aaaggaagaa tatcatatta cgaaatgcct
96181 gataaagatc taccaacgat aagatatcac ggacgtaagt ttctagatac tagagtagta
96241 tattgtcaca tgtctaaact tcaagagaga gattatatga ttactagacg acagctatgt
96301 tatcatgaaa tgtttgataa aaatatgtat aacgtgtcaa tggcagtatt gggacaactt
96361 aatctgatga ataatttaga tactttattt caggaacagg ataaggaatt gtacccaaat
96421 ctgaaaataa ataatggcgt gttatacgga gaagaattgg taacgttaaa cattagttcc
96481 aaatttaaat actttattaa tcggatacag acactcaacg gaaaacattt tatatacttt
96541 tctaattcta catatggcgg attggtaatt aaatatatca tgctcagtaa tggatattct
```

FIG. 22 (CONT.)

```
96601 gaatataatg gttctcaggg aactaatcca catatgataa acggcaaacc aaaaacattt
96661 gctatcgtta ctagtaaaat gaaatcgtct ttagaggatc tattagatgt gtataattct
96721 cctgaaaacg atgatggcag tcaattgatg tttttgtttt cgtcaaacat tatgtccgaa
96781 tcctatactc tgaaagaggt aaggcatatt tggtttatga ctatcccaga tactttttct
96841 caatacaacc aaattcttgg acgatctatt agaaaattct cttacgccga tatttctgaa
96901 ccagttaatg tatatctttt agccgccgta tattccgatt tcaatgacga agtgacgtca
96961 ttaaacgatt acacacagga tgaattaatt aatgttttac catttgacat caaaaagctg
97021 ttgtatctaa aatttaagac taaagaaacg aatagaatat actctattct tcaagagatg
97081 tctgaaacgt attctcttcc accacatcca tcaattgtaa aagttttatt gggagaattg
97141 gtcagacaat tttttataa taattctcgt attaagtata acgataccaa gttacttaaa
97201 atggttacat cagttataaa aaataaagaa gacgctagga attacataga tgatattgta
97261 aacggtcact tctttgtatc gaataaagta tttgataaat ctcttttata caaatacgaa
97321 aacgatatta ttacagtacc gtttagactt tcctacgaac catttgtttg gggagttaac
97381 tttcgtaaag aatataacgt ggtatcttct ccataaaact gatgagatat ataaagaaat
97441 aaatgtcgag ctttgttacc aatggatacc ttccagttac attggagcca cacgagctga
97501 cgttagacat aaaaactaat attaggaatg ccgtatataa gacgtatctc catagagaaa
97561 ttagtggtaa aatggccaag aaaatagaaa ttcgtgaaga cgtggaatta cctctcggcg
97621 aaatagttaa taattctgta gttataaacg ttccgtgtgt aataacctac gcgtattatc
97681 acgttgggga tatagtcaga ggaacattaa acatcgaaga tgaatcaaat gtaactattc
97741 aatgtggaga tttaatctgt aaactaagta gagattcggg tactgtatca tttagcgatt
97801 caaagtactg ctttttcga aatggtaatg cgtatgacaa tggcagcgaa gtcactgccg
```

FIG. 22 (CONT.)

```
97861 ttctaatgga ggctcaacaa ggtatcgaat ctagttttgt ttttctcgcg aatatcgttg
97921 actcataaaa aagagaatag cggtaagtat aaacacgaat actatggcaa taattgcgaa
97981 tgttttattc ccttcgatat atttttgata atatgaaaaa catgtctctc tcaaatcgga
98041 caaccatctc ataaaatagt tctcgcgcgc tggagaggta gttgctgctc gtataatctc
98101 cccagaataa tatacttgcg tgtcgtcgtt caatttatac ggatttctat agttctctgt
98161 tatataatgc ggttttccat catgattaga cgacgacaat agtgttctaa atttagatag
98221 ttgatcagaa tgaatgttta ttggcgttgg aaaaattatc catacagcgt ctgcagagtg
98281 gttgatagtt gttcctagat atgtaaaata atccaactta ctaggcagca aattgtctag
98341 ataaaatact gaatcaaacg gtgcagacgt attggtggat ctaatggaat ccaattgatt
98401 aactatcttt tgaaaatata catttttatg atccgatact tgtaagaata tagaaataat
98461 gataagtcca tcatcgtgtt tttttgcctc ttcataagaa ctatattttt tcttattcca
98521 atgaacaaga ttaatctctc cagagtattt gtacacatct atcaagtgat tggatccata
98581 atcgtcttcc tttccccaat atatacgtag tgatgataac acatattcat tggggagaaa
98641 ccctccactt atatatcctc ctttaaaatt aatccttact agttttccag tgttctggat
98701 agtggttggt ttcgactcat tataatgtat gtctaacggc ttcaatcgcg cgttagaaat
98761 tgctttttta gtttctatat taataggaga tagttgttgc ggcatagtaa aaatgaaatg
98821 ataactgttt aaaaatagct cttagtatgg gaattacaat ggatgaggaa gtgatatttg
98881 aaactcctag agaattaata tctattaaac gaataaaaga tattccaaga tcaaaagaca
98941 cgcatgtgtt tgctgcgtgt ataacaagtg acggatatcc gttaatagga gctagaagaa
99001 cttcattcgc attccaagcg atattatctc aacaaaattc agattctatc tttagagtat
99061 ccactaaact attacggttt atgtactaca atgaactaag agaaatcttt agacggttga
```

FIG. 22 (CONT.)

```
99121 gaaaaggttc tatcaacgat atcgatcctc actttgaaga gttaatatta ttgggtggta
99181 aactagataa aaaggaatct attaaagatt gtttaagaag agaattaaaa gaggaaagtg
99241 atgaacgtat aacagtaaaa gaatttggaa atgtaattct aaaacttaca acacgggata
99301 aattatttaa taaagtatat ataagttatt gcatggcgtg ttttattaat caatcgttgg
99361 aggatttatc gcatactagt atttacaatg tagaaattag aaagattaaa tcattaaatg
99421 attgtattaa cgacgataaa tacgaatatc tgtcttatat ttataatatg ctagttaata
99481 gtaaatgaac ttttacagat ctagtataat tagtcagatt attaagtata atagacgact
99541 agctaagtct attatttgcg aggatgactc tcaaattatt acactcacgg cattcgttaa
99601 ccaatgccta tggtgtcata aacgagtatc cgtgtccgct attttattaa ctactgataa
99661 caaaatatta gtatgtaaca gacgagatag ttttctctat tctgaaataa ttagaactag
99721 aaacatgtct agaaagaaac gattatttct gaattattcc aattatttgt ccaaacagga
99781 aagaagtata ctatcgtcat ttttttctct agatccagct actactgata atgatagaat
99841 agatgctatt tatccgggtg gcatacccaa aagggtgag aatgttccag agtgtttatc
99901 cagggaaatt aaagaagaag ttaatataga caattctttt gtattcatag acactcggtt
99961 ttttattcat ggcatcatag aagataccat tattaataaa ttttttgagg taatcttctt
100021 tgtcggaaga atatctttaa cgagtgatca aatcattgat acatttaaaa gtaatcatga
100081 aatcaaggat ctaatatttt tagatccgaa ttcaggtaat ggactccaat acgaaattgc
100141 aaaatatgct ctagatactg caaaactcaa atgttatggc catagaggat gttattacga
100201 atcattaaaa aaattaactg aggatgattg attagaaaat ataaattaat ttaccatcgt
100261 gtatttttat aacgggattg tccggcatat catgtagata gttaccgtct acatcgtata
```

FIG. 22 (CONT.)

```
100321 ctcgaccatc tacgccttta aatcctctat ttattgacat taatctatta gaattggaat
100381 accaaatatt agtaccctca attagtttat tggtaatatt ttttttagac gatagatcga
100441 tggctcttga aaccaaggtt ttccaaccgg actcattgtc gatcggtgag aagtcttttt
100501 cattagcatg aatccattct aatgatgtat gtttaaacac tctaaacaat tggacaaatt
100561 cttttgattt gctttgaatg atttcaaata ggtcttcgtc tacagtaggc ataccattag
100621 ataatctagc cattataaag tgcacgttta catatctacg ttctggagga gtaagaacgt
100681 gactattgag acgaatggct cttcctacta tctgacgaag agacgcctcg ttccatgtca
100741 tatctaaaat gaagatatca ttaattgaga aaaaactaat accctcgcct ccactagaag
100801 agaatacgca tgttttaatg cattctccgt tagtgtttga ttcttggtta aactcagcca
100861 ccgccttgat tctagtatct tttgttctag atgagaactc tatattagag ataccaaaga
100921 ctttgaaata tagtaataag atttctattc ctgactgatt aacaaatggt tcaaagacta
100981 gacatttacc atgggatgct aatattccca aacatacatc tataaatttg acgcttttct
101041 cttttaattc agtaaataga gagatatcag ccgcactagc atccccttc aatagttctc
101101 ccttttaaa ggtatctaat gcggatttag aaaactctct atctcttaat gaatttttaa
101161 aatcattata tagtgttgct atctcttgcg cgtattcgcc cggatcacga ttttgtcttt
101221 caggaaagct atcgaacgta aacgtagtag ccatacgtct cagaattcta aatgatgata
101281 tacctgtttt tatttcagcg agtttagcct tttgataaat ttcttcttgc tttttcgaca
101341 tattaacgta tcgcattaat actgttttct tagcgaatga tgcagaccct tctacgtcat
101401 caaaaataga aaactcgtta ttaactatgt acgaacatag gcctcctagt ttggagacta
101461 attctttctc atcaactaga cgtttattct caaatagcga ttggtgttgt aaggatcctg
101521 gtcgtagtaa gttaaccaac atggtgaatt cttgcacact attaacgata ggtgtagccg
```

FIG. 22 (CONT.)

```
101581 ataaacaaat catcttatgg ttttttaatg cgatggtctt agataaaaaa ttatatactg
101641 aacgagtagg acggatctta ccatcttctt tgattaatga tttagaaatg aagttatgac
101701 attcatcaat aatgacgcat attctactct tggaattaat agttttgata ttagtaaaaa
101761 atttatttct aaaattttga tcatcgtaat taataaaaat acaatccttc gttatctctg
101821 gagcgtatct gagtatagtg ttcatccaag gatcttctat caaagccttt ttcaccaata
101881 agataatagc ccaattcgta taaatatcct taagatgttt gagaatatat acagtagtca
101941 ttgttttacc aacacccgtt tcatggaaca ataaaagaga atgcatactg tctaatccta
102001 agaaaactct tgctacaaaa tgttgataat ccttgaggcg tactacgtct gttcccatca
102061 tttcaacagg catattagta gttctgcgca atgcataatc gatataggcc gcgtgtgatt
102121 tactcattta tgagtgataa gtaataacta tgttttaaaa atcacagcag tagtttaact
102181 agtcttctct gatgtttgtt ttcgatactt tttgaatcag aagtcatact agaataaagc
102241 aacgagtgaa cgtaatagag agcttcgtat actctattcg aaaactctaa gaacttatta
102301 atgaattccg tatccactgg attgtttaaa atactaaatt gaacactgtt cacatccttc
102361 caagaagaag acttagtgac ggacttaaca tgagacataa ataaatccaa attttttta
102421 caaacatcac tagccaccat aatggcgcta tctttcaacc agctatcgct tacgcatttt
102481 agcagtctaa catttttaaa gagactacaa tatattctca tagtatcgat tacacctcta
102541 ccgaataaag ttggaagttt aataatacaa tatttttcgt ttacaaaatc aaataatggt
102601 cgaaacacgt cgaaggttaa catcttataa tcgctaatgt atagattgtt ttcagtgaga
102661 tgattattag atttaatagc atctcgttca cgtttgaaca gtttattgtg tgcgctgagg
102721 tcggcaacta cggcgtccgc tttagtactc ctcccataat actttacgct attaatcttt
102781 aaaatttcat agactttatc tagatcgctt tctggtaaca tgatatcatg tgtaaaagt
```

FIG. 22 (CONT.)

```
102841 tttaacatgt cggtcggcat tctatttaga tcattaactc tagaaatctg aagaaagtaa
102901 ttagctccgt attccagact aggtaatggg cttttaccta aagacaagtt aagttctggc
102961 aatgtttcat aaaatggaag aaggacatgc gttccctccc ggatattttt tacaatttca
103021 tccatttaca actctatagt ttgttttcat tattattagt tattatctcc cataatcttg
103081 gtaatactta ccccttgatc gtaagatacc ttatacaggt cattacatac aactaccaat
103141 tgtttttgta cataatagat tggatggttg acatccatgg tggaataaac tactcgaaca
103201 gatagtttat ctttccccct agatacattg gccgtaatag ttgtcggcct aaagaatatc
103261 tttggtgtaa agttaaaagt tagggttctt gttccattat tgctttttgt cagtagttca
103321 ttataaattc tcgagatggg tccgttctct gaatatagaa catcatttcc aaatctaact
103381 tctagtctag aaataatatc ggtcttattc ttaaaatcta ttcccttgat gaagggatcg
103441 ttaatgaaca aatccttggc ctttgattcg gctgatctat tatctccgtt atagacgtta
103501 cgttgactag tccaaagact tacaggaata gatgtatcga tgatgttgat actatgtgat
103561 atgtgagcaa agattgttct cttagtggca tcactatatg ttccagtaat ggcggaaaac
103621 tttttagaaa tgttatatat aaaagaattt tttcgtgttc caaacattag cagattagta
103681 tgaagataaa cactcatatt atcaggaaca ttatcaattt ttacatacac atcagcatct
103741 tgaatagaaa cgataccatc ttctggaacc tcaacaatct cggcagactc cggataacca
103801 gtcggtgggc catcactaac aataactaga tcatccaaca atctactcac atatgcatct
103861 atataatctt tttcatcttg tgagtaccct ggatacgaaa taaatttatt atccgtattt
103921 ccataataag gtttagtata aacagagagc gatgttgccg catgaacttc agttacagtc
103981 gccgttggtt ggtttatttg acctattact ctcctaggtt tctctataaa cgatggttta
```

FIG. 22 (CONT.)

```
104041 atttgtacat tcttaaccat atatccaata aagctcaatt caggaacata aacaaattct
104101 ttgttgaacg tttcaaagtc gaacgaagag tcacgaataa cgatatcgga tactggattg
104161 aaggttaccg ttacggtaat ttttgaatcg gatagtttaa gactgctgaa tgtatcttcc
104221 acatcaaacg gagttttaat ataaacgtat actgtagatg gttctttaat agtgtcatta
104281 ggagttaggc caatagaaat atcattaagt tcactagaat atccagagtg tttcaaagca
104341 attgtattat tgatacaatt attatataat tcttcgccct caatttccca aataacaccg
104401 ttacacgaag agatagatac gtgattaata catttatatc caacatatgg tacgtaaccg
104461 aatcttccca tacctttaac ttctggaagt tccaaactca gaaccaaatg attaagcgca
104521 gtaatatact gatccctaat ttcgaagcta gcgatagcct gattgtctgg accatcgttt
104581 gtcataactc cggatagaga aatatattgc ggcatataca aagttggaat ttgactatcg
104641 actgcgaaga cattagaccg tttaatagag tcatccccac cgatcaaaga attaatgata
104701 gtattattca ttttctattt aaaatggaaa aagcttacaa taaactccgt agagaaatat
104761 ctataatttg tgagttttcc ttaaagtaac agcttccgta aacgccgtct ttatctctta
104821 gtaggtttat tgtatttatg accttttcct tatcttcata gaatactaaa ggcaacaaag
104881 aaatttttgg ttcttctcta agagctacgt gagacttaac catagaagcc aacgaatccc
104941 tacatatttt agaacagaaa tacccaactt caccaccctt gaatgtctca atactaatag
105001 gtctaaaaac caaatcttga ttacaaaacc aacacttatc aattacacta tttgtcttaa
105061 tagacacatc tgccatagat ttataatact ttggtagtat acaagcgagt gcttcttctt
105121 tagcgggctt aaagactgct ttaggtgctg aaataaccac atctggaagg cttactcgct
105181 tagccattta attacggaac tattttttta tacttctaat gagcaagtag aaaacctctc
105241 atctacaaaa acatactcgt gtccataatc ctctaccata gttacacgtt ttttagatct
```

FIG. 22 (CONT.)

```
105301 catatgtgct aaaaagtttt cccatactaa ttggttacta ttatttttcg tataattttt
105361 aacagtttga ggttttagat ttttagttac agaagtgata tcgaatattt tatccaaaaa
105421 gaatgaataa ttaattgtct tagaaggagt gttttcttgg caaaagaata ccaagtgctt
105481 aaatatttct actacttcat taatcttttc tgtactcaga ttcagtttct catcttttac
105541 ttgattgatt atttcaaaga ctaacttata atccttttta tttattctct cgttagcctt
105601 aagaaaacta gatacaaaat ttgcatctac atcatccgtg gatatttgat ttttttccat
105661 gatatccaag agttccgaga taatttctcc agaacattga tgagacaata atctccgcaa
105721 tacatttctc aaatgaataa gtttattaga cacatggaag tttgactttt tttgtacctt
105781 tgtacatttt tgaaatacag actcgcaaaa aatacaatat tcatatcctt gttcagatac
105841 tataccgttg tgtctacaac cgctacataa tcgtagattc atgttaacac tctacgtatc
105901 tcgtcgtcca atattttata taaaaacatt ttatttctag acgttgccag aaaatcctgt
105961 aatattttta gtttttttggg ctgtgaataa agtatcgccc taatatggtt accgtcctcc
106021 gccaatatag tagttaaatt atccgcacat gcagaagaac accgcttagg cggattcagt
106081 acaatgttat atttttcgta ccaactcatt taaatatcat aatctaaaat agttctgtaa
106141 tatgtctagc gctaatatat tgatcataat cctgtgcata aattaagata caacaatgtc
106201 tcgaaatcat cgacatggct tcttccatag ttagaagatc gtcgtcaaag ttagcaacgt
106261 gattcatcaa catttgctgt tttgaggcag caaatactga accgtcgcca ttcaaccatt
106321 cataaaaacc atcgtctgaa tccattgata atttcttgta ctggtttttg agagctcgca
106381 tcaatctagc atttctagct cccggattga aaacagaaag aggatcgtac atccagggtc
106441 cattttctgt aaatagaatc gtataatgtc ccttcaagaa gatatcagac gatccacaat
106501 caaagaattg gtctccgagt ttgtaacaaa ctgcggactt taacctatac atgataccgt
```

FIG. 22 (CONT.)

```
106561 ttagcatgat ttctggtgat acgtcaatcg gagtatcatc tattagagat ctaaagccgg
106621 tgtaacattc tccaccaaac atattcttat tctgacgtcg ttctacataa aacatcattg
106681 ctccattaac gataacaggg gaatgaacag cactacccat cacattagtt cccaatggat
106741 caatgtgtgt aactccagaa catcttccat atcctatgtt aggaggagcg aacaccactc
106801 ttccactatt gccatcgaat gccatagaat aaatatcctt ggaattgata gaaatcggac
106861 tgtcggatgt tgtgatcatc ttcataggat taacaactat gtatggtgcc gcctgaagtt
106921 tcatatcgta actgatgccg tttataggtc tagccacaga aaccaacgta ggtctaaatc
106981 caactataga caaaatagaa gccaatatct gttcttcatc tgtcataact tgagagcatc
107041 cagtatgaat aatcttcatt agatggggat ctaccgcatc atcatcgtta caataaaaaa
107101 ttcccattct aatgttcata attgcttttc taatcatggt atgcatgttt gctctctgaa
107161 tctctgtgga aattagatct gatacacctg taatcactat cggattatcc tccgtaagac
107221 gattaaccaa caacatataa ttataagact ttacttttct aaattcataa agttgctgga
107281 ttaggctata ggtgtctcca tgtacatacg cgttctcgag cgcaggaagt ttaataccga
107341 atagtgccat cagaatagga tgaatatagt aattagtttc tggttttcta taaataaaag
107401 acaaatcttg tgaactagac atatcggtaa aatgcatgga ttggaatcgt gtagtcgaca
107461 gaagaatatg atgattagat ggagagtata ttttatctaa ctctttgagt tggtcaccga
107521 ttctaggact agctcgagaa tgaataagta ctaaaggatg agtacatttc acagaaacac
107581 tagcattgtt caatgtgctc tttacatggg taaggagttg aaatagctcg tttctatttg
107641 ttctgacaat atttagttta ttcataatgt taagcatatc ctgaatagta aagttagatg
107701 tgtcatactt gttagtagtt agatatttag caattgcatt cccatcattt ctcaatctcg
```

FIG. 22 (CONT.)

```
107761 tactccaatc atgcgtggat gctacttcgt cgatggaaac catacaatcc tttttgatag
107821 gctgttgaga ttgattattt cctgcacgtt taggtttggt acgttgattt ctagcccctg
107881 cggatataaa gtcatcgtct acaattttgg ataatgaatt gcatacacta caagacaaag
107941 atttatcaga agtgtgaata tgatcttcat ctaccaaaga aagagtttga ttagtataac
108001 tagattttag tcctgcgtta gatgttaaaa aaacatcgct attgaccacg gcttccatta
108061 tttatattcg tagtttttac tcgaaagcgt gattttaata ttcaatctta ttacttttgg
108121 aatcgttcaa aacctttgac taattgtaga atttgatcta ttgccctacg cgtatactcc
108181 cttgcatcat atacgttcgt caccagatcg tttgtttcgg cctgaagttg gtgcatatct
108241 ctttcaacat tcgacatgag atccttaagg gccatatcgt ctagattttg ttgagatgct
108301 gctcctggat ttggattttg ttgtgctgtt gtacatactg taccaccagt aggtgtagga
108361 gtacatacag tggccacaat aggaggttga ggaggtgtaa ccgttggagt agtacaagaa
108421 atacttccat ccgattgttg tgtacatgta gttgttggta acgtctgaga aggttgggta
108481 gatggcggcg tcgtcgtctt ttgatcttta ttaaatttag agataatatc ctgaacagca
108541 ttgctcggcg tcaacgctgg aaggagtgaa ctcgccggcg catcagtatc tgcagacagc
108601 caatcaaaaa gattagacat atcagatgat gtattagttt gttgtcgtgg ttttggtgta
108661 ggagccggtg tagctgttgg aaccggctgt ggagttatat gaatagttgg ttgtagcggt
108721 tggataggct gtctgctggc ggccatcata ttatctctag ctagttgttc tcgcaactgt
108781 ctttgataat acgactcttg agactttagt cctatttcaa tcgcttcatc ctttttcgta
108841 tccggatcct tttcttcaga ataatagatt gacgactttg gtgtagagga ttctgccagc
108901 ccctgtgaga acttgttaaa gaagtccatt taaggcttta aaattgaatt gcgattataa
108961 gattaaatgg cagacacaga cgatattatc gactatgaat ccgatgatct caccgaatac
```

FIG. 22 (CONT.)

```
109021 gaggatgatg aagaagagga agaagatgga gagtcactag aaactagtga tatagatccc
109081 aaatcttctt ataagattgt agaatcagca tccactcata tagaagatgc gcattccaat
109141 cttaaacata tagggaatca tatatctgct cttaaacgac gctatactag acgtataagt
109201 ctatttgaaa tagcgggtat aatagcagaa agctataact tgcttcaacg aggaagatta
109261 cctctagttt cagaattttc tgacgaaacg atgaagcaaa atatgctaca tgtaattata
109321 caagagatag aggagggttc ttgtcctata gtcatcgaaa agaacggaga attgttgtcg
109381 gtaaacgatt ttgacaaaga tggtctaaaa ttccatctag actatattat caaaatttgg
109441 aaacttcaaa aacgatatta gaatttatac gaatatcgtt ctctaaatgt cacaatcaag
109501 tctcgcatgt tcagcaattt attgtcgtac tttatatcgt gttcattaac gatatcttgc
109561 aaaatagtaa tgattctatc ttccttcgat agatattctt cagagattat tgtcttatat
109621 tctttcttgt tatcagatat gaatttgata agactttgaa cattattgat acccgtctgt
109681 ttaatttttt ctacagatat tttagttttg gcagattcta tcgtatctgt caatagacat
109741 ccaacatcga cattcgacgt caattgtcta taaatcaacg tataaatttt agaaataaca
109801 ttagcgaatt gttgtgcatt gatgtcgtta ttctgaaaca gtatgatttt aggtagcatt
109861 ttcttaacaa agagaacgta tttattgtta ctcagttgaa cagatgatat atccagatta
109921 ctaacgcatc tgattccata taccaaactt tcagaagaaa tggtgtacaa ttgtttgtat
109981 tcattcaatg tctcttttc agaaattagt ttagagtcga atactgcaat aattttcaag
110041 agatagtttt catcagataa gattttattt agtgtagata tgataaaact attgttttgt
110101 tggagaactt gatacgccgc gttctctgta gtcgacgctc tcaaatggga aacaatctcc
110161 attatttttt tggaatcgga tacaatatct tcggtatctt gacgcaatct agtatacata
110221 gagttaagag aaattagagt ttgtacatta agcaacatgt ctctaaatgt ggctgcaaac
```

FIG. 22 (CONT.)

110281 ttttcctttt ccacatcatc tagtttatta tataccgatt tcacaacggc accagattta
110341 aggaaccaga atgaaaaact ctgataacta caatatttca tcatagttac gattttatca
110401 tcttctatag ttggtgtaat agcgcatacc ttttctccca agactggaac caacgtcata
110461 aaaatgttta aatcaaaatc catatcaaca tctgatgcgc taagaccagt ctcgcgttca
110521 agattatctt tactaatggt gacgaactca tcgtatagaa ctctaagttt gtccattatt
110581 tatttacaga tttagttgtt taatttattt gtgctcttcc agagttggga tagtattttt
110641 ctaacgtcgg tattatatta ttaggatcta cgttcatatg tatcataata ttaatcatcc
110701 acgttttgat aaatctatct ttagcttctg aaataacgta tttaaacaaa ggagaaaaat
110761 atttagctac ggcatcagac gcaataacat tttttgtaaa tgtaacgtat ttagacgaca
110821 gatcttcgtt aaaaagtttt ccatctatgt agaatccatc ggttgttaac accattcccg
110881 cgtcagattg aataggagtt tgaatagttt gttttggaaa tagatccttc aataacttat
110941 agttgggtgg gaaaaaatcg attttatcac tagactcttt cttttttact atcattacct
111001 catgaactat ttcttgaatg agtatatgta ttttctttcc tatatcggac gcgttcattg
111061 gaaaatatac catgtcgtta actataagaa tatttttatc ctcgtttaca aactgaataa
111121 tatcagatgt agttcgtaaa cgaactatat catcaccagc acaacatcta actatatgat
111181 atccactagt ttcctttagt cgtttattat cttgttccat attagcagtc attccatcat
111241 ttaagaaggc gtcaaagata atagggagaa atgacatttt ggattctgtt acaactttac
111301 caaaattaag gatatacgga cttactatct ttttctcaac gtcgatttga tgaacacacg
111361 atgaaaatgt acttcgatga gattgatcat gtagaaaaca acaagggata caatatttcc
111421 acatatcatg aaatatatta agaaatccca ccttattata tttccccaaa ggatccatgc

FIG. 22 (CONT.)

111481 atgtaaacat tatgccgtta tcattaataa agacttcttt ctcatcggat ctgtaaaagt
111541 tgttactgat ttttttcatt ccaggatcta gataattaat aatgatgggt tttctattct
111601 tattctttgt attttggcat atcctagacc agtaaacagt ttccactttg gtaaaatcag
111661 cagacttttg aacgctatta aacatggcat taatggcaat aactaaaaat gtaaaatatt
111721 tttctatgtt aggaatatgg tttttcactt taatagatat atggtttttg gccaaaatga
111781 tagatatttt tttatccgag gatagtaaaa tattattagt cgccgtctct ataaaaatga
111841 agctagtctc gatatccaat tttattctag aattgatagg agtcgccaaa tgtaccttat
111901 acgttatatc tcccttgatg cgttccattt gtgtatctat atcggacaca agatctgtaa
111961 atagttttac gttattaatc atcacggtat cgccgtcgct agataacgct aatgtaccat
112021 ccaagtccca aatggagaga tttaactgtt catcgtttag aataaaatga ttaccggtca
112081 tattaataaa gtgttcatcg tatctagata acaacgactt ataattaatg tccaagtctt
112141 gaactcgctg aatgatcttt tttaacccag ttagttttag attggtacga aatatattgt
112201 taaactttga ttctacagta atgtccaaat ctagttgtgg aaatacttcc atcaacattg
112261 tttcaaactt gataatatta ttatctacat cttcatacga tccaaattcc ggaatagatg
112321 tatcgcacgc tctggccacc cagataacca aaaagtcaca cgctccagga tatacattgt
112381 ataaaaagct atcgtttttt agtagtgttt ttttctgagt atatacgaag ggattaaaaa
112441 tagtattatc aacgtaacta tattccaaat tattcttatg agaatagata ataatatcgt
112501 ccttaatatc taacaaattt cctaaatatc cctttaattg agtcattcga agcgtcaata
112561 gaatatgtct cttaactatt tccggctgtt gtatatttaa atgacttcgt aaaaaataat
112621 atatgggcga cttctcatct atgtaatcat atggagtgag atatagggct cgttctacct
112681 cctgcccctt acccacctgt aataccaatt gcggacttac tatatatcgc atatttatat

FIG. 22 (CONT.)

112741 cgtggggtaa agtgaaaatc tactaccgat gatgtaagtc ttacaatgtt cgaaccagta
112801 ccagatctta atttggaggc ctccgtagaa ctaggggagg taaatataga tcaaacaaca
112861 cctatgataa aggaaaatag cggttttata tcccgtagta gacgtctatt cgcccataga
112921 tctaaggatg atgagagaaa actagcacta cgattctttt tacaaagact ttattttta
112981 gatcatagag agattcatta tttgttcaga tgcgttgacg ctgtaaaaga cgtcactatt
113041 accaaaaaaa ataacattat cgtggcgcct tatatagcac ttttaactat cgcatcaaaa
113101 ggatgcaaac ttacagaaac aatgattgaa gcattctttc cagaactata taatgaacat
113161 agtaagaaat ttaaattcaa ctctcaagta tccatcatcc aagaaaaact cggataccag
113221 tttggaaact atcacgttta tgattttgaa ccgtattact ctacagtagc tctggctatt
113281 cgagatgaac attcatctgg cattttaat atccgtcaag agagttatct ggtaagttca
113341 ttatctgaaa taacatatag attttatcta attaatctaa aatctgatct tgttcaatgg
113401 agtgctagta cgggcgctgt aattaatcaa atggtaaata ctgtattgat tacagtgtat
113461 gaaaagttac aactggtcat agaaaatgat tcacaattta catgttcatt ggctgtggaa
113521 tcaaaacttc caataaaatt acttaaagat agaaatgaat tatttacaaa attcatcaac
113581 gagttaaaaa agaccagttc attcaagata agcaaacgcg ataaggatac gctactaaaa
113641 tattttactt aggactggag ttagaattta tagacgactc atttcgttta tcattattag
113701 tattcttctt gttatcttgt tcagaaatat acagcaatgc tatgcctaat actaaataca
113761 ttatcatgct tgcaatggct ctaacaacga cgaaccaaaa tgaatttggt cgtagctttt
113821 gttcacaaaa atacataaag aaatgtctac ataaatctat ggcgccattg gctacttgaa
113881 atagcgccag tcctcctaca gattttaata tagctgtata acatgacatt tattcatcat
113941 caaaagagac agagtcacca tctgtcatat ttagattttt tttcatgtgt tcaaagtatc

FIG. 22 (CONT.)

```
114001 ctctactcat ttcattataa tagtttatca tacttagaat tttaggacgg atcaatgagt
114061 aagacttgac tagatcgtca gtagtaattt gtgcatcgtc tattctgcat ccgcttcgtc
114121 gaataatgta tagcatcgct ttgagattct ccatagctat caagtcttta tacaatgaca
114181 tggaaatatc tgtgaatact ttatacttct ccaacatcga tgccttaaca tcatcgccta
114241 ctttagcatt gaaaatacgt tctattgtgt agatggatgt agcaagattt ttaaacaaca
114301 atgccatttt acacgatgat tgcctcaagt ctccaatcgt ttgtttagaa cgattagcta
114361 cagagtccaa tgcttggctg actagcatat tattatcttt agaaattgta ttcttcaatg
114421 aggcgtttat catatctgtg atttcgttag tcatattaca gtctgactgg gttgtaatgt
114481 tatccaacat atcacctatg gatacggtac acgtaccagc atttgtaata atcctatcta
114541 agatgttgta tggcattgcg cagaaaatat cttctcctgt aatatttcca ctctcgataa
114601 atctactcag attattctta aatgccttat tctctggaga aaagatatca gtgtccatca
114661 tttcattaat agtatacgca gaaaagatac cacgagtatc aattctatcc aagatactta
114721 tcggttccga gtcacagata atggtttcct ctccttcggg agatcctgca tagaaatatc
114781 taggacaata gtttctatac tgtctgtaac tctgataatc tctaaagtca ctaactgata
114841 ccatgaaatt gagaagatca aacgctgaag taattaattt ttctgcctcg tttttactac
114901 aactagtttt catcaatgta gtgacgatgt attgtttagt tactcttggt ctaatactga
114961 tgatagagat attattactt cccataatgg atcttctagt agtcacctta aagcccattg
115021 atgcaaatag cagatagata aagtcttggt atgactcctt tctaatatag tacggactac
115081 ctttgtcacc caactttata cccacataag ccataacaac ctctttaata gccgtttcat
115141 gaggtttatc agccatgagc ctgagtagtt ggaagaatct catgaatcct gtctcagaaa
```

FIG. 22 (CONT.)

```
115201 gtcctatatg catgatagat ttatctttcc tgggaaactc tcgtatagtc atagatgaaa
115261 tactcttcaa agtttctgaa ataagattag taacagtctt acctccgact actctaggta
115321 acaaacaaac tctaataggt gttttctctg cggagataat atcagaaagg atagagcaat
115381 aagtagtatt attgtgatta taaagaccga atacataaca ggtagaattt ataaacatca
115441 tgtcctgaag gtttttagac ttgtattcct cgtaatccat accgtcccaa aacatggatt
115501 tggtaacttt gatagccgta gatctttgtt ccttcgccaa caggttaaag aaattaataa
115561 agaatttgtg gtttctacct atgtctacaa attgcacgtt tggaagcgcc acggttacat
115621 tcactgcagc attttgagga tcgcgagtat gaagtacgat gttattgttt actggtatat
115681 ctggaaagaa ttctaccagt ctaggaataa gagattgata tcgcatagaa atacaaaagt
115741 tcataatctc atcatctaag agcattttgt taccattgta ataaatatcc actctgtcat
115801 atgtataaat gaagtactgt tcaaacatga tgagatgttt atatgttggc atagtagtga
115861 gatctacgtt tggtaatggc aatgtattaa gattaactcc ataatgtcta gcagcatctg
115921 cgatgttata agcgttgtca aagcggggtc gatcttgtgc tgttatatat tgtctaacac
115981 ctataagatt atcaaaatct tgtctgctta atacaccgtt aacaattttt gccttgaatt
116041 cttttattgg tgcattaata acatccttat agaggatgtt aaacaaataa gtgttatcaa
116101 agttaagatc tggatatttc ttttctgcta gaacatccat tgagtcggag ccatctggtt
116161 taatataacc accgataaat ctagctctgt attctgtatc cgtcaatcta atattaagaa
116221 ggtgttgagt gaaaggtgga agatcgtaaa agctgtgagt attaatgata ggattagttt
116281 ccgaactaat gttaattggg gtattaataa tatctatatt tccagcgtta agtgtaacat
116341 taaacagttt taattcacgt gacgtggtat caattaaata attaatgccc aatttggata
116401 tagcagcctg aagctcatct tgtttagtta cggatcctaa tgagttatta agcaatatat
```

FIG. 22 (CONT.)

```
116461 cgaacggatg aacgaaggtt gttttaagtt ggtcacatac tttgtaatct agacatagat
116521 gcggaagaac ggtagaaact atacgaaata aatattcaga gtcctctaat tgatcaagag
116581 taactattga cttaataggc atcatttatt tagtattaaa tgacgaccgt accagtgacg
116641 gatatacaaa acgatttaat tacagagttt tcagaagata attatccatc taacaaaaat
116701 tatgaaataa ctcttcgtca aatgtctatt ctaactcacg ttaacaacgt ggtagataga
116761 gaacataatg ccgccgtagt gtcatctcca gaggaaatat cctcacaact taatgaagat
116821 ctatttccag atgatgattc tccggccact attatcgaac gagtacaacc tcatactact
116881 attattgacg atactccacc tcctacgttt cgtagagagt tattgatatc ggaacaacgt
116941 caacaacgag aaaaaagatt taatattaca gtatcgaaaa atgctgaagc aataatggaa
117001 tctagatcta tgatatcttc tatgccaaca caaacaccat ccttgggagt agtttatgat
117061 aaagataaaa gaattcagat gttggaggat gaagtggtta atcttagaaa tcaacgatct
117121 aatacaaaat catctgataa tttagataat tttaccagaa tactatttgg taagactccg
117181 tataaatcaa cagaagttaa taagcgtata gccatcgtta attatgcaaa tttgaacggg
117241 tctcccttat cagtcgagga cttggatgtt tgttcagagg atgaaataga tagaatctat
117301 aaaacgatta aacaatatca cgaaagtaga aaacgaaaaa ttatcgtcac taacgtgatt
117361 attattgtca taaatattat cgagcaagca ttgctaaaac tcggatttga agaaatcaaa
117421 ggactgagta ccgatatcac ttcagaaatt atcgatgtgg agatcggaga tgactgcgat
117481 gctgtagcat caaaactagg aatcggtaac agtccggttc ttaatattgt attgtttata
117541 ctcaagatat tcgttaaacg aattaaaatt atttaattta atacattccc atatccagac
117601 aacaatcgtc tggattaatc tgttcctgtc gtctcatacc ggacgacata ttaatctttt
117661 tattagtagg catcttttta gatggtttct ttttcccagc attaactgag tcgataccta
```

FIG. 22 (CONT.)

```
117721 gaagatcgtg attgatctct ccgaccattc cacgaacttc taattggccg tctctgacgg
117781 taccataaac tattttacca gcattagtaa cagcttggac aatctgacca tccatcgcat
117841 tgtacgatgt agtagtaact gttgttctac gtctaggagc accagaagta tttttggagc
117901 ccttggatgt tgatgtagaa gaagacgagg attttgattt tggtttacat gtaatacatt
117961 ttgtatcaca tgcgccggca gtcacatctg tttgagaatt aagattattg ttgcctcctt
118021 tgacggctgc atctccaccg atttgcgcta gtagattttt aagctgtggt gtaatcttat
118081 taactgtttc gatataatca tcgtaactgc ttctaacggc taaatttttt ttatccgcca
118141 tttagaagct aaaaatattt ttatttatgc agaagattta actagattat acaatgaact
118201 aatatgatcc ttttccagat tatttacaaa cttggtattt tttggttctg gaggaggcga
118261 atttaaattc ggacttggat ttggattttg tgggttcttg atcttattat acagcgcata
118321 taggatggcg acggtaactg ctacgcaaat accgatcaac aaaagaatac caatcattta
118381 ttgacaataa cttcactatt gatcaagtat gcaatatatc atcttttcac taaataagta
118441 gtaataatga ttcaacaatg tcgagatata tggacgataa taatttagtt catggaaata
118501 tcgctatgat tggtatgaat gactccgcta actctgtggg gcgcgcagtg ctttccccac
118561 atagaataaa ttagcattcc gactgtgata ataataccaa gtataaacgc cataatactc
118621 aatactttcc atgtacgagt gggactggta gacttactaa agtcaataaa ggcgaagata
118681 cacgaaagaa tcaaaagaat gattccagcg attagcacgc cggaaaaata atttccaatc
118741 ataagcatca tatccattta actaataaaa attttaaatc gccgaatgaa caaagtggaa
118801 tataaaccat ataaaaacaa tagtttgtac tgcaaaaata atatctattt ttgttttcga
118861 agatatggta aaattaaata gtagtacaca gcatgttata actaacagca gcaacggctc
```

FIG. 22 (CONT.)

118921 gtaattactt atcatttact agacgaaaag gtggtgggat attttcttgc tcaaataata
118981 cgaatatatc acccatccat tttatgcgat gtttatatac tctaatcttt aatagatcta
119041 tagacgacgg gtttaccaac aatatagatt ttatcgattc atctaattta aacccttcct
119101 taaacgtgaa tgatctatta tctggcataa cgatgactct acccgatgaa tcggacaatg
119161 tactgggcca tgtagaataa attatcaacg aattatcgtc tacgaacatt tatatcattt
119221 gttttaattt tagtacgcga ataaatagat ataaaataga aaataacaga tattacaacc
119281 aatgttatgg ccgcgcccaa ccaggtaggc agttttattt tatcttttac tacaggttct
119341 cctggatgta cgtcaccaac ggcggacgta gttctagtac aattagacgt aagttccgct
119401 tgggaatttt ttaacgctaa agagttaacg ttaatcgtgc acccaacgta tttacatcta
119461 gttctttgaa catcttgatt ataatataac cattttctat ctctagattc gtcggtgcac
119521 tcatgtaacc aacataccct aggtcctaaa tatttatctc cggaattaga ttttggataa
119581 ttcgcgcacc aacaatttct atttccttta tgatcgttac aaaagacgta taatgccgta
119641 tccccaaaag taaaataatc aggacgaata attctaataa actcagaaca atatctcgca
119701 tccatatgtt tggagcaaat atcggaataa gtagacatag ccggtttccg ttttgcacgt
119761 aaccattcta aacaattggg gtttccagga tcgtttctac aaaatccagt catgaaatca
119821 tcacaatgtt ctgtcttgta attattatta aatattttg gacagtgttt ggtatttgtc
119881 ttagaacaac attttgccac gctatcacta tcgcccagga gataatcctt ttttataaaa
119941 tgacatcgtt gcccggatgc tatataatca gtagcgtgtt ttaaatcctt aatatattca
120001 ggagttacct cgttctgata atagattaat gatccaggac gaaatttgaa agaactacat
120061 ggttctccat gaattaatac atattgttta gcaaattcag gaactataaa actactacaa
120121 tgatctatcg acataccatc tatcaaacaa aacttgggtt taatttctcc cggagatgtt

FIG. 22 (CONT.)

120181 tcataatagt acgtataact ttcttctgca aacttaacag ctctattata ttcaggataa
120241 ttaaaaccta attccatata tttgtctcgt atatctgcta ttcctggtgc tattttgatt
120301 ctattaagag taacggctgc ccccattttt aataatcgtc agtatttaaa ctgttaaatg
120361 ttggtatatc aacatttacc ttatttcccg cagtataagg tttgttgcag gtatactgtt
120421 caggaatggt tacatttata ctttttctat agtcctgtct ttcgatgttc atcacatatg
120481 caaagaacag aataaacaaa ataatgtaag aaataatatt aaatatctgt gaattcgtaa
120541 atacattgat tgccataata attacagcag ctacaataca tacaatagac attcccacag
120601 tgttgccatt acctccacga tacatttgag ttactaagca ataggtaata actaagctag
120661 taagaggcaa tagaaaagat gagataaata tcatcaatat agagattaga ggagggctat
120721 atagagccaa gacgaacaaa atcaaaccga gtaacgttct aacatcatta tttttgaaga
120781 ttcccaaata atcattcatt cctccataat cgttttgcat catacctcca tctttaggca
120841 taaacgattg ctgctgttcc tctgtaaata aatctttatc aagcactcca gcacccgcag
120901 agaagtcgtc aagcatattg taatatctta aataactcat ttatatatta aaaaatgtca
120961 ctattaaaga tggagtataa tctttatgcc gaactaaaaa aaatgacttg tggtcaaccc
121021 ctaagtcttt ttaacgaaga cggggatttc gtagaagttg aaccgggatc atcctttaag
121081 tttctgatac ctaagggatt ttacgcctct ccttccgtaa agacgagtct agtatttgaa
121141 acattaacaa cgaccgataa taaaattact agtatcaatc caacaaatgc gccaaagtta
121201 tatcctcttc aacgcaaagt cgtatctgaa gtagtttcta atatgaggaa aatgatcgaa
121261 tcaaaacgtc ctctatacat cactcttcac ttggcgtgtg gatttggtaa gactattacc
121321 acgtgttatc ttatggctac acacggtaga aaaaccgtca tttgcgtacc caataaaatg
121381 ttaatacatc aatggaagac acaggtagag gcagtcggat tggaacataa gatatccata

FIG. 22 (CONT.)

```
121441 gatggagtaa gtagtctatt aaaggaacta aagactcaaa gtccggatgt attaatagta
121501 gtcagtagac atctgacaaa cgatgccttt tgtaaatata tcaataagca ttatgatttg
121561 ttcatcttgg atgaatcaca tacgtataat ctgatgaaca atacagcagt tacaagattt
121621 ttagcgtatt atcctccgat gatgtgttat tttttaactg ctacacctag accatctaac
121681 agaatttatt gtaacagtat tattaatatt gccaagttat ccgatctaaa aaaaactatc
121741 tatgcagtag atagtttttt tgagccatat tccacagata atattagaca tatgataaaa
121801 cgattagatg gaccatctaa taaatatcat atatataccg agaagttatt atctgtagac
121861 gagcctagaa atcaacttat tcttaatacc ctggtagaag aattcaagtc aggaactatt
121921 aatcgcattt tagttattac taaactacgt gaacatatgg tattcttcta caaacgatta
121981 ttagattttt tcggatcaga ggttgtattt ataggagacg cccaaaatag acgtactcca
122041 gatatggtca aatcaatcaa ggaactaaat agatttatat tcgtatccac cttattttat
122101 tccggtactg gtttagatat tcctagtttg gattctttgt tcatttgctc ggcagtaatc
122161 aacaatatgc aaatagagca attactaggg agggtatgtc gagaaacaga actattagat
122221 aggacggtat atgtatttcc tagcacatcc atcaaagaaa taaagtacat gataggaaat
122281 ttcgttcaac gaattattag tctgtctgta gataaactag gatttaaaca aaaaagttat
122341 cggaaacatc aagaatccga tcccacttct gtatgtacaa catcctccag agaagaacgt
122401 gtattaaata gaatatttaa ctcgcaaaat cgttaagaag tttaagcgac gatccgcatg
122461 ctgcgcaggc cagtgtatta cccctcatag tattaatata atccaatgat acttttgtga
122521 tgtcggaaat cttaaccaat ttagactgac aggcagaaca cgtcatgcaa tcatcatcgt
122581 catcgataac tgtagtcttg ggcttctttt tgcggctctt cattccggaa cgcacattgg
```

FIG. 22 (CONT.)

```
122641 tgctatccat ttaggtagta aaaaataagt cagaatatgc cctatagcac gatcgtgcaa
122701 aacctggtat atcgtctcta tctttatcac aatatagtgt atcgacatct ttattattat
122761 tgacctcgtt tatcttggaa catggaatgg gaacattttt gttatcaacg gccacctttg
122821 ccttaattcc agatgttgta aaattataac taaacagtct atcatcgaca caaatgaaat
122881 tcttgtttag acgtttgtag tttacgtatg cggctcgttc gcgtctcatt ttttcagata
122941 ttgcaggtac tataatatta aaaataagaa tgaaataaca taggattaaa aataaagtta
123001 tcatgacttc tagcgctgat ttaactaact taaaagaatt acttagtctg tacaaaagtt
123061 tgaaattttc agattctgcg gctatagaaa agtataattc tttggtagaa tggggaacat
123121 ctacttactg gaaaataggc gtgcaaaagg tagctaatgt cgagacgtca atatctgatt
123181 attatgatga ggtaaaaaat aaaccgttta atattgatcc gggctattac attttcttac
123241 cggtatattt tgggagcgtc tttatttatt cgaagggtaa aaatatggta gaacttggat
123301 ctggaaactc ttttcaaata ccagatgata tgcgaagtgc gtgtaacaaa gtattagaca
123361 gcgataacgg aatagacttt ctgagatttg ttttgttaaa caatagatgg ataatggaag
123421 atgctatatc aaaatatcag tctccagtta atatatttaa actagctagt gagtacggat
123481 taaacatacc caaatattta gaaattgaaa tagaggaaga cacattattt gacgacgagt
123541 tatactctat tatagaacgc tctttcgatg ataaatttcc aaaaatatcc atatcgtata
123601 ttaagttggg agaacttagg cggcaagttg tagacttttt caaattctca ttcatgtata
123661 ttgagtccat caaggtagat cgtataggag ataatatttt tattcctagc gttataacaa
123721 aatcaggaaa aaagatatta gtaaaagatg tagaccattt aatacgatcc aaggttagag
123781 aacatacatt tgtaaaagta aaaaagaaaa acacattttc cattttatac gactatgatg
123841 gaaacggaac agaaactaga ggagaagtaa taaaacgaat tatagacact ataggacgag
```

FIG. 22 (CONT.)

```
123901 actattatgt taacggaaag tatttctcta aggttggtag tgcaggctta aagcaattga
123961 ctaataaatt agatattaat gagtgcgcaa ctgtcgatga gttagttgat gagattaata
124021 aatccggaac tgtaaaacga aaaataaaaa accaatcagc atttgattta agcagagaat
124081 gtttgggata tccagaagcg gattttataa cgttagttaa taacatgcgg ttcaaaatag
124141 aaaattgtaa ggttgtaaat ttcaatattg aaaatactaa ttgtttaaat aacccgagta
124201 ttgagactat atatggaaac tttaaccagt tcgtctcaat ctttaatatc gtcaccgatg
124261 tcaaaaaaag attattcgag tgaaataata tgcgcctttg atataggtgc aaaaaatcct
124321 gccagaactg ttttagaagt caaggataac tccgttaggg tattggatat atcaaaatta
124381 gactggagtt ctgattggga aaggcacata gctaaagatt tgtcacaata tgaatacact
124441 acagttcttc tagaacgtca gcctagaagg tcgccgtacg tcaaatttat ctattttatt
124501 aaaggctttt tatatcatac atcggctgcc aaagttattt gcgtctcgcc tgtcatgtct
124561 ggtaattcat atagagatcg aaaaaagaga tcggtcgaag catttcttga ttggatggac
124621 acattcggat tgcgagactc cgttccggat agacgcaaat tagacgatgt agcggatagt
124681 ttcaatttgg ctatgagata cgtattagat aaatggaata ctaattatac accttataat
124741 aggtgtaaat ctagaaatta cataaaaaaa atgtaataac gttagtaacg ccattatgga
124801 taatctattt acctttctac atgaaataga agatagatat gccagaacta tttttaactt
124861 tcatctaata agttgcgatg aaataggaga tatatatggt cttatgaaag aacgcatttc
124921 ctcagaggat atgtttgata atatagtgta taataaagat atacatcatg ccattaagaa
124981 actagtgtat tgcgacatcc aacttactaa acacattatt aatcagaata cgtatccggt
125041 atttaacgat tcttcacaag tgaaatgttg tcattatttc gatataaact cagataatag
125101 caatattagc tctcgtacag tagagatatt tgagagggaa aagtcatctc ttgtatcata
```

FIG. 22 (CONT.)

```
125161 tattaaaact accaataaga agagaaaggt caattatggg gaaataaaga aaactgtaca
125221 tggaggcact aatgcaaatt acttttccgg taaaaagtct gatgagtatc tgagcactac
125281 agtcaggtcc aacattaatc aaccttggat caaaaccatt tctaagagaa tgagagtaga
125341 tatcattaat cactctatag taacgcgtgg aaaaagctct atattacaaa ctatagaaat
125401 tatttttact aatagaacat gtgtgaaaat attcaaggat tctactatgc acattattct
125461 atccaaggac aaggatgaaa aggggtgtat acacatgatt gacaaattat tctatgtcta
125521 ttataattta tttctgttgt tcgaggatat catccaaaac gagtacttta aagaagtagc
125581 taatgttgta aaccacgtac tcacggctac ggcattagat gagaaattat tcctaattaa
125641 gaaaatggct gaacacgatg tttatggagt tagcaatttc aaaataggga tgtttaacct
125701 gacatttatt aagtcgttgg atcataccgt tttcccctct ctgttagatg aggatagcaa
125761 aataaagttt tttaaggga aaaagctcaa tattgtagca ttacgatctc tggaggattg
125821 tataaattac gtgactaaat ccgagaatat gatagaaatg atgaaggaaa gatcgactat
125881 tttaaatagc atagatatag aaacggaatc ggtagatcgt ctaaaagaat tgcttctaaa
125941 atgaaaaaaa aacactaatt cagaaatgga tcaacgactc ggatataagt ttttggtgcc
126001 tgatcctaaa gccggagttt tttatagacc gttacatttc caatatgtat cgtattctaa
126061 ttttatattg catcgattgc atgaaatctt gaccgtcaag cggccactct tatcgtttaa
126121 gaataataca gaacgaatta tgatagaaat tagcaatgtt aaagtgactc ctccagatta
126181 ctcacctata atcgcgagta ttaaaggtaa gagttatgac gcattagcca cgttcactgt
126241 aaatatcttt aaagaggtaa tgaccaaaga gggtatatcc atcactaaaa taagtagtta
126301 tgagggaaaa gattctcatt tgataaaaat tccgctacta ataggatacg ggaataaaaa
```

FIG. 22 (CONT.)

```
126361 tccacttgat acagccaagt atcttgttcc taatgtcata ggtggagtct ttatcaataa
126421 acaatctgtc gaaaaagtag gaattaatct agtagaaaag attacaacat ggccaaaatt
126481 tagggttgtt aagccaaact cattcacttt ctcgttttcc tccgtatccc ctcctaatgt
126541 attaccgaca agatatcgcc attacaagat atctctggat atatcacaat tggaagcgtt
126601 gaatatatca tcgacaaaga catttataac ggtcaatatt gttttgctgt ctcaatattt
126661 atctagagtg agtctagaat tcattagacg tagtttatca tacgatatgc ctccagaagt
126721 tgtctatcta gtaaacgcga taatagatag tgctaaacga attactgaat ctattactga
126781 ctttaatatt gatacataca ttaatgacct ggtggaagct gaacacatta aacaaaaatc
126841 tcagttaacg atcaacgagt tcaaatatga aatgctgcat aactttttac ctcatatgaa
126901 ctatacaccc gatcaactaa agggatttta tatgatatct ttactaagaa agtttctcta
126961 ctgtatctac cacacttcta gatatccaga tagagattcg atggtttgtc atcgcatcct
127021 aacgtacggc aaatattttg agacgttggc acatgatgaa ttagagaatt acataggcaa
127081 catccgaaac gatatcatga acaatcacaa gaacagaggc acttacgcgg taaacattca
127141 tgtactaaca actcctggac ttaatcatgc attttctagt ctattgagtg gaaagttcaa
127201 aaagtcagac ggtagttatc gaacacatcc tcactattca tggatgcaga atatttctat
127261 tcctaggagt gttggatttt atccggatca agtaaagatt tcaaagatgt tttctgtcag
127321 aaaataccat ccaagtcaat atctttactt ttgttcatcg gacgttccgg aaagaggtcc
127381 tcaggtaggt ttagtatctc aattgtctgt cttgagttcc attacaaata tactaacgtc
127441 tgagtatttg gatttggaaa agaaaatttg tgagtatatc agatcatatt ataaagatga
127501 tataagttac tttgaaacag gatttccaat cactatagaa aatgctctag tcgcatctct
127561 taatccaaat atgatatgtg attttgtaac tgactttaga cgtagaaaac ggatgggatt
```

FIG. 22 (CONT.)

```
127621 cttcggtaac ttggaggtag gtattacttt agttagggat cacatgaatg aaattcgcat
127681 taatattgga gcgggaagat tagtcagacc attcttggtt gtggataacg gagagctcat
127741 gatggatgtg tgtccggagt tagaaagcag attagacgac atgacattct ctgacattca
127801 gaaagagttt ccgcatgtca tcgaaatggt agatatagaa caatttactt ttagtaacgt
127861 atgtgaatcg gttcaaaaat ttagaatgat gtcaaaggat gaaagaaagc aatacgattt
127921 atgtgacttt cctgccgaat ttagagatgg atatgtagca tcttcactag tgggaatcaa
127981 tcacaattct ggacccagag ctattcttgg atgtgctcaa gctaaacaag ctatctcttg
128041 tctgagctcg gatatacgaa ataaaataga caatggaatt catttgatgt atccagagag
128101 gccaatcgtg attagtaagg ctttagaaac ttcaaagatt gcggctaatt gcttcggcca
128161 acatgttact atagcattaa tgtcgtacaa aggtatcaat caagaggatg gaattatcat
128221 caaaaaacaa tttattcaga gaggcggtct cgatattgtt acagccaaga aacatcaagt
128281 agaaattccg ttggaaaact ttaataacaa agaaagagat aggtctaacg cctattcaaa
128341 attagaaagt aatggattag ttagactgaa tgctttcttg gaatccggag acgctatagc
128401 acgaaatatc tcatcaagaa ctcttgaaga tgattttgct agagataatc agattagctt
128461 tgatgtttcc gaaaaatata ccgatatgta caaatctcgc gttgaacgag tacaagtaga
128521 acttactgac aaagttaagg tacgagtatt aaccatgaaa gaaagaagac ccattctagg
128581 agacaaattt accactagaa cgagtcaaaa gggaacagtc gcgtatatcg cggatgaaac
128641 ggaacttcca tacgatgaaa atggtatcac accagatgtc attattaatt ctacatccat
128701 cttctctaga aaaactatat ctatgttgat agaggttatt ttaacagccg catattctgc
128761 taagccgtac aacaataagg gagaaaaccg acctgtctgt tttcctagta gtaacgaaac
128821 atccatcgat acatatatgc aattcgctaa acaatgttat gagcattcaa atccgaaatt
```

FIG. 22 (CONT.)

128881 gtctgatgaa gaattatcgg ataaaatctt ttgtgaaaag attctctatg atcctgaaac
128941 ggataagcct tatgcatcca aagtattttt tggaccaatt tattacttgc gtctgaggca
129001 tttaactcag gacaaggcaa ccgttagatg tagaggtaaa aagacgaagc tcattagaca
129061 ggcgaatgag ggacgaaaac gtggaggagg tatcaagttc ggagaaatgg agagagactg
129121 tttaatagcg catggtgcag ccaatactat tacagaagtt ttgaaagatt cggaagaaga
129181 ttatcaagat gtgtatgttt gtgaaaattg tggagacata gcagcacaaa tcaagggtat
129241 taatacatgt cttagatgtt caaaacttaa tctctctcct ctcttaacaa aaattgatac
129301 cacgcacgta tctaaagtat ttcttactca aatgaacgcc agaggcgtaa aagttaaatt
129361 agatttcgaa cgaaggcctc cttcgtttta taaaccatta gataaagttg atctcaaacc
129421 gtcttttctg gtgtaatatt ctagtttggt agtagataca tatcaatatc atcaaattcg
129481 agatccgaat tataaaatgg gcgtggattg ttaactatag aatcggacgt ctgatattcg
129541 aaaatctgtg gagttttagg ttttggtgga ggtgtaactg ctacttggga tactgaagtc
129601 tgatattcag aaagctgggg gatgttctgg ttcgacatcc accgatggtg tcacatcact
129661 aatcggttcg gtaacgtctg tggacgatgg aggcaccact tctacaggtt ctggttcttt
129721 atcctcagtc atcaacggag ctacttcaat gcgaggaaat gtataatttg gtaatggttt
129781 ctcatgtgga tctgaagaag aggtaagata tctactagaa agataccgat cacgttctag
129841 ttctcttttg tagaacttaa ctttttcttt ctccgcatct agttgatatt ccaacctctt
129901 cacgttcgca tgggttacct ccgcagtttt tacgagcgat ttcacgttca gccttcatgc
129961 gtcttatagc atgaattcgc ttatcgttat cgggtttagc ttctgtcacc ttagcaattc
130021 ctttttatt aaactctaca taatcatatc catttctatt gtttgttcta atataaacga

FIG. 22 (CONT.)

```
130081 gtatagcatc attgctaaat ttttcaatag tatcgaaaac agaatatcct aaaccatata
130141 atatatattc aggaacactc aaactaaatg tccaggattc tcctaaatac gtaaacttta
130201 atagtgcgaa atcattcaaa aatctaccac ttatagatag atagatagta cataaatgcg
130261 tatagtagtc tacctatctc tttattatga aaaccggcat tacgatcata tatgtcgtga
130321 tatacctgtg atccgtttac gttaaaccat aaatacatgg gtgatcctat aaacatgaat
130381 ttatttctaa ttctcagagc tatagttaat tgaccgtgta atatttgctt acatgcatac
130441 ttgatacgat cattaataag atttttatca ttgctcgtta tttcagaatc gtatatataa
130501 ggagtaccat cgtgattctt accagatatt atacaaaata ctatatataa aatatattga
130561 cccacgttag taatcatgta aatgtttaac gttttaaatt ttgtattcaa tgatccatta
130621 tcatacgcta gcatggtctt atgatattca ttctttaaaa tataatattg tgttagccat
130681 tgcattgggg ctcctaatgg agatttttta ttctcatcca ttttaggata ggctttcata
130741 aagtccctaa taacttcgtg aataatgttt ctatgttttc tactgatgca tgtatttgct
130801 tcgatttttt tatcccatgt ttcatctatc atagatttaa acgcagtaat gctcgcaaca
130861 ttaacatctt gaaccgttgg tacaattccg ttccataaat ttataatgtt cgccatttat
130921 ataactcatt ttttgaatat acttttaatt aacaaaagag ttaagttact catatggacg
130981 ccgtccagtc tgaacatcaa tctttttagc cagagatatc atagccgctc ttagagtttc
131041 agcgtgattt tccaacctaa atagaacttc atcgttgcgt ttacaacact tttctatttg
131101 ttcaaacttt gttgttacat tagtaatctt tttttccaaa ttagttagcc gttgtttgag
131161 agtttcctca ttgtcgtctt catcggcttt aacaattgct tcgcgtttag cctctggctt
131221 tttagcagcc gttgtagaaa aaaattcagt tgctggaatt gcaagatcgt catctccggg
131281 gaaaagagtt ccgtccattt aaagtacaga ttttagaaac tgacactctg cgttatttat
```

FIG. 22 (CONT.)

```
131341 atttggtaca acacatggat tataaatatt gatgttaata acatcagaaa atgtaaagtc
131401 tatacattgt tgcatcgtgt taaattttct aatggatcta gtattattgg gtccaacttc
131461 tgcctgaaat ccaaatatgg aagcggatac aaaaccgttt cctggataaa ccacacatct
131521 ccacttttgc tttacatcag aaattgtgtc gttgacatct tgaactctcc tatctaatgc
131581 cggtgttcca cctatagatt ttgaatattc gaatgctgca tgagtagcat taaattcctt
131641 aatattgcca taattttcat atattgagta accctggata aaaagtaaac acaccgcagc
131701 cgtagctacc acaataaaaa aaattgatag agagttcatt tataatctat tagaagctga
131761 caaaattttt ttacacgcat cagacaatgc tttaataaat agttcaacat ctacttttgt
131821 catatcgaac cgatggtatg attctaacct agaattacat ccgaaaaagt tgactatgtt
131881 catagtcatt aagtcattaa caaacaacat tccagactct ggattataag acgatactgt
131941 ttcgtcacaa ttacctacct taatcatgtg attatgaata ttggctatta gagcaccttc
132001 taagaaatct ataatatctt tgaaacacga tttaaaatca aaccacgaat atacttctac
132061 gaagaaagtt agtttaccca taggagaaat aactataaat ggagatctaa atacaaaatc
132121 cggatctatg atagttttaa cattattata ttctctatta aatacctcca catctaaaaa
132181 tgttaatttt gaaactatgt cttcgtttat taccgtacct gaactaaacg ctataagctc
132241 tattgtttga gaactcttta aacgatattc ttgaaataca tgtaacaaag tttcctttaa
132301 ctcggtcggt ttatctacca tagttacaga atttgtatcc ttatctataa tataataatc
132361 aaaatcgtat aaagttatat aattatcgcg ttcagattgg gatcttttca aatagactaa
132421 aaaccccatt tctctagtaa gtatcttatg tatatgtttg taaaatatct tcatggtggg
132481 aatatgctct accgcagtta gccattcctc attgacagcg gtagatgtat tagacaaaac
132541 tattccaatg tttaacaagg gccattttac gagattatta aatccttgtt tgataaatgt
```

FIG. 22 (CONT.)

```
132601 agccaatgag ggttcgagtt caacgacgat tgaattctct tcccgcggat gctgcatgat
132661 gaacgacggg atgttgttcg attgatttgg aattcttttt cgactttttg tttatattaa
132721 atattttaaa atttatagcg gatagcaatt catgtaccac ggataatgta gacgcgtatt
132781 gcgcatcgat atctttatta ttagataaat ttatcaataa atgtgagaag tttgcctcgt
132841 taaggtcttc catttaaata ttatataaac atttgtgttt gtatcttatt cgtcttttat
132901 ggaatagttt tttactagta aagctgcaat tacacacttt gtccgtaaaa cataaatata
132961 aacaccagct tttatcaatc gttccaaaaa gtcgacggcg gacattttta acatggcatc
133021 tattttaaat acacttaggt ttttggaaaa aacatcattt tataattgta acgattcaat
133081 aactaaagaa aagattaaga ttaaacataa gggaatgtca tttgtatttt ataagccaaa
133141 gcattctacc gttgttaaat acttgtctgg aggaggtata tatcatgatg atttggttgt
133201 attgggaaag gtaacaatta atgatctaaa gatgatgcta ttttacatgg atttatcata
133261 tcatggagtg acaagtagtg gaacaattta caaattggga tcgtctatcg atagactttc
133321 tctaaatagg actattgtta caaaagttaa taattataat tatgatacat tttttgacga
133381 tgatgattga tcgctattgc acaattttgt ttttttactt tctaatatag cgtttagatt
133441 ctttttcatg tgcgaatatt gatttactaa aatatctatg tttaactttt gttctataac
133501 gtccttatcg gcggtatcgg tacatatacg taattcacct tcacaaaata cggagtcttc
133561 gataataata gccaatcgat tattggatct agctgtctgt atcatattca acatgtttaa
133621 tatatccttt cgtttcccct ttacaggcat cgatcgtagc atattttccg cgtctgagat
133681 ggaaatgtta aaactacaaa aatgcgtaat gttagcccgt cctaatattg gtacgtgtct
133741 ataagtttgg catagtagaa taatagacgt gtttaaatgc cttccaaagt ttaagaattc
```

FIG. 22 (CONT.)

```
133801 tattagagta ttgcattttg atagtttatc gcctacatca tcaaaaataa gtaaaaagtg
133861 tgctgatttt ttatgatttt gtgcgacagc aatacatttt tctatgttac ttttagttcg
133921 tatcagatta tattctagag attcctgact actaacgaaa ttaatatgat ttggccaaat
133981 gtatccatca taatctggat tataaacggg tgtaaacaag aatacatgtt tatatttttt
134041 aactagtgta gaaaacagag atagtaaata gatagttttt ccagatccag atcctcccgt
134101 taaaaccatt ctaaacggca tttttaataa attttctctt gaaaattgtt tttcttggaa
134161 acaattcata attatattta cagttactaa attaatttga taataaatca aaatatggaa
134221 aactaaggtc gttagtaggg aggagaacaa agaaggcaca tcgtgacata aataacattt
134281 attatcatga tgacaccaga aaacgacgaa gagcagacat ctgtgttctc cgctactgtt
134341 tacagagaca aaattcaggg aaagaataaa cgcaaacgcg tgattggtct atgtattaga
134401 atatctatgg ttatttcact actatctatg attaccatgt ccgcgtttct catagtgcgc
134461 ctaaatcaat gcatgtctgc taacgaggct gctattactg acgccgctgt tgccgttgct
134521 gctgcatcat ctactcatag aaaggttgcg tctagcacta cgcaatatga tcacaaagaa
134581 agctgtaatg gtttatatta ccagggttct tgttatatat tacattcaga ctaccagtta
134641 ttctcggatg ctaaagcaaa ttgcactgcg gaatcatcaa cactacccaa taaatccgat
134701 gtcttgacta cctggctcat tgattatgtt aaggatacat ggggatctga tggtaatcca
134761 attacaaaaa ctacatccga ttatcaagat tctgatgtat cacaagaagt tagaaagtat
134821 ttttgtgtta aaacaatgaa ctaatattta tttttgtaca ttaataaatg aaatcgctta
134881 atagacaaac tgtaagtagg tttaagaagt tgtcggtgcc ggtcgctata atgatgatac
134941 tctcaaccat tattagtggc ataggaacat ttctgcatta caaagaagaa ctgatgccta
135001 gtgcttgcgc caatggatgg atacaatacg ataaacattg ttatttagat actaacatta
```

FIG. 22 (CONT.)

135061 aaatgtctac agataatgcg gtttatcagt gtcgtaaatt acgagccaga ttgcctagac
135121 cggatactag acatctgaga gtattgttta gtatttttta taaagattat tgggtaagtt
135181 taaaaaagac caatgataaa tggttagata ttaataatga taaagatata gatattagta
135241 aattaacaaa ttttaaacaa ctaaacagta cgacggatgc tgaagcgtgt tatatataca
135301 agtctggaaa actggttaaa acagtatgta aaagtactca atctgtacta tgtgttaaaa
135361 aattctacaa gtgacaacaa aaaatgaatt aataataagt cgttaacgta cgccgccatg
135421 gacgccgcgt ttgttattac tccaatgggt gtgttgacta taacagatac attgtatgat
135481 gatctcgata tctcaatcat ggactttata ggaccataca ttataggtaa cataaaaact
135541 gtccaaatag atgtacggga tataaaatat tccgacatgc aaaaatgcta ctttagctat
135601 aagggtaaaa tagttcctca ggattctaat gatttggcta gattcaacat ttatagcatt
135661 tgtgccgcat acagatcaaa aaataccatc atcatagcat gcgactatga tatcatgtta
135721 gatatagaag ataaacatca gccattttat ctattcccat ctattgatgt ttttaacgct
135781 acaatcatag aagcgtataa cctgtataca gctggagatt atcatctaat catcaatcct
135841 tcagataatc tgaaaatgaa attgtcgttt aattcttcat tctgcatatc agacggcaat
135901 ggatggatca taattgatgg gaaatgcaat agtaattttt tatcataaaa gttgtaaagt
135961 aaataataaa acaataaata ttgaactagt agtacgtata ttgagcaatc agaaatgatg
136021 ctggtacctc ttatcacggt gaccgtagtt gcgggaacaa tattagtatg ttatatatta
136081 tatatttgta ggaaaaagat acgtactgtc tataatgaca ataaaattat catgacaaaa
136141 ttaaaaaaga taaagagttc taattccagc aaatctagta aatcaactga tagcgaatca
136201 gactgggagg atcactgtag tgctatggaa caaaacaatg acgtagataa tatttctagg
136261 aatgagatat tggacgatga tagcttcgct ggtagtttaa tatgggataa cgaatccaat

FIG. 22 (CONT.)

```
136321 gttatggcgc ctagcacaga acacatttac gatagtgttg ctggaagcac gctgctaata
136381 aataatgatc gtaatgaaca gactatttat cagaacacta cagtagtact taatgaagat
136441 accaaacaga atcctaacta ttcatccaat cctttcgtaa attataataa aaccagtatt
136501 tgtagcaagt caaatccgtt cattacagaa ctcaacaata aatttagtga gaataatccg
136561 tttagacgag cacatagcga tgattatctt aataagcaag aacaagatca tgaacacgat
136621 gatatagaat cattggtgtg attagtttcc tttttataaa attgaagtaa tatttagtat
136681 tattgctgcc gtcacgttgt acaaatggag atattccctg tattcggcat ttctaaaatt
136741 agcaatttta ttgctaataa tgactgtaga tattatatag atacagaaca tcaaaaaatt
136801 atatctgatg agatcaatag acagatggat gaaacggtac ttcttaccaa catcttaagc
136861 gtagaagttg taaatgacaa tgagatgtac catcttattc ctcatagatt atcgacgatt
136921 atactctgta ttagttctgt cggaggatgt gttatctcta tagataatga cgtcaatggc
136981 aaaaatattc taacctttcc cattgatcat gctgtaatca tatccccact gagtaaatgt
137041 gtcgtagtta gcaagggtcc tacaaccata ttggttgtta aagcggatat acctagcaaa
137101 cgattggtaa catcgtttac aaacgacata ctgtatgtaa acaatctatc actgattaat
137161 tattcgccgt tgtctgtatt cattattaga cgagttaccg actatttgga tagacacata
137221 tgcgatcaga tatttgcgaa taataagtgg tattccatta taaccatcga caataagcag
137281 tttcctattc catcaaactg tataggtatg tcctctgcca agtacataaa ttctagcatc
137341 gagcaagata ctttaataca tgtttgtaac ctcgagcatc cattcgactt agtatacaaa
137401 aaaatgcagt cgtacaattc tgtacctatc aaggaacaaa tattgtacgg tagaattgat
137461 aatataaata tgagcattag tatttctgtg gattaataga tttctagtat ggggatcatt
```

FIG. 22 (CONT.)

```
137521 aatcatctct aatctctaaa tacctcataa aacgaaaaaa aagctattat caaatactgt
137581 acggaatgga ttcattctct tctcttttta tgaaactctg ttgtatatct actgataaaa
137641 ctggaagcaa aaaatctgat aaaaagaata agaataagat caaggattat tataaaataa
137701 caatagttcc tggttcctct tccacgtcta ctagctcgtg gtattataca catgcctagt
137761 aatagtctct ttgcgttgac ggaaagcaga ctagaaataa caggctaaaa tgttcagaca
137821 ccataatagt tcccaaccca gataataaca gagtaccatc aacacattcc tttaaactca
137881 atcccaaacc caaaaccgtt aaaatgtatc cggccaattg atagtagata atgaggtgta
137941 cagcgcatga tgatttacac agtaaccaaa atgaaaatac tttagtaatt ataagaaata
138001 tagatggtaa cgtcatcatc aacaatccaa taatatgccg gagagtaaac attgacggat
138061 aaaacaaaaa tgctccgcat aactctatca tggcaataac acaaccaaat acttgtaaga
138121 ttcctaaatt agtagaaaat acaacggata tcgatgtata agtgatctcg agaaataata
138181 agaataaagt aatgcccgta aagataaaca tcaacattgt ttggtaatca ttaaaccaat
138241 tagtatgaag ttgaactaat ttcacagtag attttattcc agtattatcc ccgcatgtat
138301 aagtacctgg taagatatct ttatattcca taatcaatga gacatcacta tctgataacg
138361 aatgaagtct agcactagta tgccatttac ttaatattgt cgtcttggaa gttttattat
138421 aagttaaaat atcatggtta tccaatttcc atctaatata ctttgtcgga ttatctatag
138481 tacacggaat aatgatggta tcattacatg ctgtatactc tatggtcttt gtagttgtta
138541 taacaaccaa cgtatagagg tatatcaacg atattctaac tcttgacatt ttttatttat
138601 ttaaaatgat acctttgtta tttattttat tctattttgc taacggtatt gaatggcata
138661 agtttgaaac gagtgaagaa ataatttcta cttacttatt agacgacgta ttatacacgg
138721 gtgttaatgg ggcggtatac acattttcaa ataataaact aaacaaaact ggtttaacta
```

FIG. 22 (CONT.)

```
138781 ataataatta tataacaaca tctataaaag tagaggatgc ggaaccaata acggaaatcc
138841 caaatgttgg aaaatagacg gttcagacga cccaaaacat agaggtagag gatacgctcc
138901 ttatcaaaat agcaaagtaa cgataatcag tcacaacgga tgtgtactat ctgacataaa
138961 catatcaaaa gaaggaatta aacgatggag aagatttgac ggaccatgtg gttatgattt
139021 atacacggcg gataacgtaa ttccaaaaga tggtttacga ggagcattcg tcgataaaga
139081 tggtacttat gacaaagttt acattctttt cactgatact atcggctcaa agagaattgt
139141 caaaattccg tatatagcac aaatgtgcct aaacgacgaa ggtggtccat catcattgtc
139201 tagtcataga tggtcgacgt ttctcaaagt cgaattagaa tgtgatatcg acggaagaag
139261 ttatagacaa attattcatt ctagaactat aaaaacagat aatgatacga tactatatgt
139321 attcttcgat agtccttatt ccaagtccgc attatgtacc tattctatga ataccattaa
139381 acaatctttt tctacgtcaa aattggaagg atatacaaag caattgccgt ctccagctcc
139441 tggtatatgt ttaccagctg gaaaagttgt tccacatacc acgtttgaag tcatagaaaa
139501 atataatgta ctagatgata ttataaagcc tttatctaac caacctatct tcgaaggacc
139561 gtctggtgtt aaatggttcg atataaagga gaaggaaaat gaacatcggg aatatagaat
139621 atacttcata aaagaaaatt ctatatattc gttcgataca aaatctaaac aaactcgtag
139681 ctcgcaagtc gatgcgcgac tattttcagt aatggtaact tcgaaaccgt tatttatagc
139741 agatataggg ataggagtag gaatgccaca aatgaaaaaa atacttaaaa tgtaatctta
139801 atcgagtaca ccgcacgaca atgaacaaac ataagacaga ttatgctggt tatgcttgct
139861 gcgtaatatg cggtctaatt gttggaatta tttttacagc gacactatta aaagttgtag
139921 aacgtaaatt agttcataca ccatcaatag ataaaacgat aaaagatgca tatattagag
139981 aagattgtcc tactgactgg ataagctata ataataaatg tatccattta tctactgatc
```

FIG. 22 (CONT.)

```
140041 gaaaaacctg ggaggaagga cgtaatgcat gcaaagctct aaatccaaat tcggatctaa
140101 ttaagataga gactccaaac gagttaagtt ttttaagaag cattagacgc ggatattggg
140161 taggagaatc cgaaatatta aaccagacaa ccccatataa ttttatagct aaaaatgcca
140221 cgaagaatgg aactaaaaaa cggaaatata tttgtagtac aacgaatact cccaaactac
140281 atttttatca taccactact tcggttagat gttttagaaa aaaataaata tcgccgtacc
140341 gttcttgttt ttataaaaat aacaattaac aattatcaaa ttttttcttt aatattttac
140401 gtggttgacc attcttggtg gtaaaataat ctcttagtgt tggaatggaa tgctgtttaa
140461 tgtttccgca ctcatcgtat attttgacgt atgcagtcac atcgtttacg caatagtcag
140521 actgtagttc tatcatgctt cctacatcag aaggaggaac agttttaaag tctcttggtt
140581 ttaatctatt gccattagtt ttcatgaaat cctttgtttt atccacttca cattttaaat
140641 aaatgtccac tatacattct tctgttaatt ttactagatc gtcatgggtc atagaattta
140701 taggttccgt agtccatgga tccaaactag caaacttcgc gtatacggta tcgcgattag
140761 tgtatacacc aactgtatga aaattaagaa aacagtttaa taaatcaaca gaaatattta
140821 atcctccgtt tgatacagat gcgccatatt tatggatttc ggattcacac gttgtttgtc
140881 tgaggtgttc gtctagtgtt gcttctacgt aaacttcgat tcccatatat tctttattgt
140941 cagaatcgca taccgattta tcatcataca ctgtttgaaa actaaatggt atacacatca
141001 aaataataaa taataacgag tacattctgc aatattgtta tcgtaattgg aaaaatagtg
141061 ttcgagtgag ttggattatg tgagtattgg attgtatatt ttattttata ttttatattt
141121 tgtagtaaga atagaatgct aatgtcaagt ttattccaat agatgtctta ttaaaaaaca
141181 tatataataa ataacaatgg ctgaatggca taaaattatc gaggatatct caaaaaataa
```

FIG. 22 (CONT.)

```
141241 taagttcgag gatgccgcca tcgttgatta caagactaca aagaatgttc tagctgctat
141301 tcctaacaga acatttgcca agattaatcc tctcatcact aatcgtaata ttctaaaacc
141361 tcttattggt cagaaatatt gtattgtata tactaactct ctaatggatg agaacacgta
141421 tgctatggag ttgcttactg ggtacgcccc tgtatctccg atcgttatag cgagaactca
141481 taccgcactt atatttttga tgggtaagcc aacaacatcc agacgtgacg tgtatagaac
141541 gtgtagagat cacgctaccc gtgtacgtgc aactggtaat taaaataaaa agtaatattc
141601 atatgtagtg tcaattttaa atgatgatga tgaaatggat aatatccata ttgacgatgt
141661 caataatgcc ggtattggca tacagttcat cgatttttag atttcattca gaggatgtgg
141721 aattatgtta tgggcatttg tattttgata ggatctataa tgtagtaaat ataaaatata
141781 atccgcatat tccatataga tataatttta ttaatcgcac gttaaccgta gatgaactag
141841 acgataatgt ctttttttaca catggttatt ttttaaaaca caaatatggt tcacttaatc
141901 ctagtttgat tgtctcatta tcaggaaact taaaatataa tgatatacaa tgctcagtaa
141961 atgtatcgtg tctcattaaa aatttggcaa cgagtacatc tactatatta acatctaaac
142021 ataagactta ttctctacat cggtccacgt gtattactat aataggatac gattctatta
142081 tatggtataa agatataaat gacatctatg attttactgc aatatgtatg ctaatagcgt
142141 ctacattgat agtgaccata tacgtgttta aaaaaataaa aatgaactct taattatgct
142201 atgctattag aaatggataa aatcaaaatt acggttgatt caaaaattgg taatgttgtt
142261 accatatcgt ataacttgga aaagataact attgatgtca cacctaaaaa gaaaaaagaa
142321 aaggatgtat tattagcgca atcagttgct gtcgaagagg caaaagatgt caaggtagaa
142381 gaaaaaaata ttatcgatat tgaagatgac gatgatatgg atgtagaaag cgcataatac
142441 gatctataaa aataagtata taaatacttt ttatttactg tactcttact gtgtagtggt
```

FIG. 22 (CONT.)

```
142501 gataccctac tcgattattt ttttaaaaaa aaatacttat tctgattctt ctagccattt
142561 ccgtgttcgt tcgaatgcca catcgacgtt aaagataggg gagtagttga aatctagttc
142621 tgcattgttg gtacgcacct caaatgtagt gttggatatc ttcaacgtat agttgttgag
142681 tagtgatggt tttctaaata gaattctctt catatcattc ttgcacgcgt acatttttag
142741 catccatctt ggaatcctag atccttgttc tattcccaat ggtttcatca atagaagatt
142801 aaacatatcg tacgaacacg atggagagta atcgtagcaa aagtaagcat ttcctttaat
142861 ctcagatccc ggatactgga tatattttgc agccaacacg tgcatccatg cagcatttcc
142921 tacatatacc cggctatgta ccgcgttatc atcgactgta cgatacataa tgttaccgtg
142981 ttgcttacat tgctcgtaaa agactttcat caatttgtct ccttctccgt aaattccagt
143041 gggtcttagg caacaagtat acaattttgc tccattcatg attacggaat tattggcttt
143101 cataaccagt tgctcggcca tacgtttact ttttgcgtat acatgtcctg gtgatatatc
143161 ataaagggta tgctcatggc cgatgaatgg atcaccgtgt ttattgggtc ctattgcttc
143221 catgctacta gtatagatca aatacttgat tcctaggtcc acacaagctg ccaatatagt
143281 ctgtgttcca taatagttta ctttcatgat ttcattatcg gtgtattttc caaatacatc
143341 cactagagca gctgtatgaa taatcagatt taccccatct agcgcttctc ttaccttatc
143401 aaagtcgttt atatcacatt gtatatagtt tataacctta actttcgagg ttattggttg
143461 tggatcttct acaatatcta tgactctgat ttcttgaaca tcatctgcac taattaacag
143521 ttttactata tacctgccta gaaatccggc accaccagta accgcgtaca cggccattgc
143581 tgccactcat aatatcagac tacttattct attttactaa ataatggctg tttgtataat
143641 agaccacgat aatatcagag gagttattta ctttgaacca gtccatggaa aagataaagt
143701 tattggatta aaatccggaa cgtatagttt gataattcat cgttacggag atattagtca
```

FIG. 22 (CONT.)

```
143761 aggatgtgat tccataggca gtccagaaat atttatcggt aacatctttg taaacagata
143821 tggtgtagca tatgtttatt tagatacaga tgtaaatata tctacaatta ttggaaaggc
143881 gttatctatt tcaaaaaatg atcagagatt agcgtgtgga gttattggta tttcttacat
143941 aaatgaaaag ataatacatt ttcttacaat taacgagaat ggcgtttgat atatcagtta
144001 atgcgtctaa aacaataaat gcattagttt acttttctac tcagcaaaat aaattagtca
144061 tacgtaatga agttaatgat acacactaca ctgtcgaatt tgatagggac aaagtagttg
144121 acacgtttat ttcatataat agacataatg actccataga gataagaggg gtgcttccag
144181 aggaaactaa tattggttgc gcggttaata cgccggttag tatgacttac ttgtataata
144241 agtatagttt taaactgatt ttagcagaat atataagaca cagaaatact atatccggca
144301 atatttattc ggcattgatg acactagatg atttggctat taaacagtat ggagacattg
144361 atctattatt taatgagaaa cttaaagtag actccgattc gggactattt gactttgtca
144421 actttgtaaa ggatatgata tgttgtgatt ctagaatagt agtagctcta tctagtctag
144481 tatctaaaca ttgggaattg acaaataaaa aatataggtg tatggcatta gccgaacata
144541 tatctgatag tattccaata tctgagctat ctagactacg atacaatcta tgtaagtatc
144601 tacgcgggca cactgagagc atagaggatg aatttgatta ttttgaagac gatgattcgt
144661 ctacatgttc tgccgtaacc gacagggaaa cggatgtata atttttttta tagcgtgaag
144721 gatatgataa aaaatataat tgttgtattt atcccattcc aatcacctta tatgattctg
144781 taacacaatg aaggagtctt atagatgtat agaggtcaga tactggtttg ataaactgtt
144841 tattccacat aagtatgttt gactttatgg ttagacccgc atactttaac aaatcactga
144901 aaattggagt taggtattga cctctcagaa tcagttgccg ttctggaaca ttaaatgtat
```

FIG. 22 (CONT.)

```
144961 tttttatgat atactccaac gcatttatgt gggcatacaa caagtcatta ctaatggagt
145021 attccaagag aagagatttc aacagactgt ttatgaactc gaatgccgcc tcattgtcgc
145081 ttatattgat gatgtcgaat tctcccaata tcatcaccga tgagtagctc atcttgttat
145141 cgggatccaa gttttctaaa gatgtcatta aaccctcgat catgaatgga tttatcatca
145201 tcgtttttat gttggacatg agcttagtcc gtttgtccac atctatagac gacgatttct
145261 gaattatttc atatatccct ctctttaact ccaggaactt gtcaggatgg tctactttaa
145321 tatgttctcg tctaagagat gaaaatcttt ggatggttgc acgcgacttt tctctaaagg
145381 atcctctctt aaatgaatcc atcttatcct tggacaagat ggacagtcta ttttccttag
145441 atggtttaat atttttgtta cccatgatct ataaaggtag acctaatcgt ctcggatgac
145501 catatattta ttttcagttt tattatacgc ataaattgta aaaaatatgt taggtttaca
145561 aaaatgtctc gtggggcatt aatcgttttt gaaggattgg acaaatctgg aaaaacaaca
145621 caatgtatga acatcatgga atctataccg gcaaacacga taaaatatct taactttcct
145681 cagagatcca ctgtcactgg aaagatgata gatgactatc taactcgtaa aaaaacctat
145741 aatgatcata tagttaatct attattttgt gcaaatagat gggagtttgc atcttttata
145801 caagaacaac tagaacaggg aattacttta atagttgata gatacgcatt ctctggagta
145861 gcgtatgccg ccgctaaagg cgcgtcaatg actctcagta agagttatga atctggattg
145921 cctaaacccg acttagttat attcttggaa tctggtagca aagaaattaa tagaaacgtc
145981 ggcgaggaaa tttatgaaga tgttacattc caacaaaagg tattacaaga atataaaaaa
146041 atgattgaag aaggagatat tcattggcaa attatttctt ctgaattcga ggaagatgta
146101 aagaaggagt tgattaagaa tatagttata gaggctatac acacggttac tggaccagtg
146161 gggcaactgt ggatgtaata gtgaaattac attttttata aatggatgaa gcatattact
```

FIG. 22 (CONT.)

```
146221 ctggcaactt ggaatcagta ctcggatacg tgtccgatat gcataccgaa ctcgcatcaa
146281 tatctcaatt agttattgcc aagatagaaa ctatagataa tgatatatta aacaaggaca
146341 ttgtaaattt tatcatgtgt agatcaaact tggataatcc atttatctct ttcctagata
146401 ctgtatatac tattatagat caagagatct atcagaccga attgattaat tcattagacg
146461 acaatgaaat tatcgattgt atagttaaca agtttatgag cttttataag gataacctag
146521 aaaatatagt agatgctatc attactctaa aatatataat gaataatcca gattttaaaa
146581 ctacgtatgc cgaagtactc ggttccagaa tagcggatat agatattaaa caagtgatac
146641 gtgagaatat actacaattg tctaataata tccgcgaacg atatttgtga aaatattaaa
146701 aaaaaatact tttttattta aatgacgtcg cttcgcgaat ttagaaaatt atgctgtgat
146761 atatatcacg catcaggata taaagaaaaa tctaaattaa ttagagactt tataacagat
146821 agggatgata aatatttgat cattaagcta ttgcttcccg gattagacga tagaatttat
146881 aacatgaacg ataaacaaat tataaaatta tatagtataa tatttaaaca atctcaggaa
146941 gatatgctac aagatttagg atacggatat ataggagaca ctattaggac tttcttcaaa
147001 gagaacacag aaatccgtcc acgagataaa agcattttaa ctttagaaga agtggatagt
147061 tttttaacta cgttatcatc cgtaactaaa gaatcgcatc aaataaaatt attgactgat
147121 atcgcatccg tttgtacatg taatgattta aaatgtgtag tcatgcttat tgataaagat
147181 ctaaaaatta aagcgggccc tcggtacgta cttaacgcta ttagtcctca tgcctatgat
147241 gtgtttagaa aatctaataa cttgaaagag ataatagaaa atgcatctaa acaaaatcta
147301 gactctatat ctatttctgt tatgactcca attaatccca tgttagcgga atcgtgtgat
147361 tctgtcaata aggcgtttaa aaaatttcca tcaggaatgt ttgcggaagt caaatacgat
147421 ggtgaaagag tacaagttca taaaaataat aacgagtttg ccttctttag tagaaacatg
```

FIG. 22 (CONT.)

```
147481 aaaccagtac tctctcataa agtggattat ctcaaagaat acataccgaa agcatttaaa
147541 aaagctacgt ctatcgtatt ggattctgaa attgttcttg tagacgaaca taatgtaccg
147601 ctcccgtttg gaagtttagg tatacacaaa aagaaagaat ataaaaactc taacatgtgt
147661 ttgttcgtgt ttgactgttt gtactttgat ggattcgata tgacggacat tccattgtac
147721 gaacgaagat cttttctcaa agatgttatg gttgaaatac ccaatagaat agtattctca
147781 gagttgacga atattagtaa cgagtctcag ttaactgacg tattggatga tgcactaacg
147841 agaaaattag aaggattggt cttaaaagat attaatggag tatacgaacc gggaaagaga
147901 agatggttaa aaataaagcg agactatttg aacgagggtt ccatggcaga ttctgccgat
147961 ttagtagtac taggtgctta ctatggtaaa ggagcaaagg gtggtatcat ggcagtcttt
148021 ctaatgggtt gttacgacga tgaatccggt aaatggaaga cggttaccaa gtgttcagga
148081 cacgatgata atacgttaag ggagttgcaa gaccaattaa agatgattaa aattaacaag
148141 gatcccaaaa aaattccaga gtggttagta gttaataaaa tctatattcc cgattttgta
148201 gtagaggatc caaaacaatc tcagatatgg gaaatttcag gagcagagtt tacatcttcc
148261 aagtcccata ccgcaaatgg aatatccatt agatttccta gatttactag gataagagag
148321 gataaaacgt ggaaagaatc tactcatcta aacgatttag taaacttgac taaatcttaa
148381 tagttacata caaattaaaa taacactatt tagttggtgg tcgccatgga tggtgttatt
148441 gtatactgtc taaacgcgtt agtaaaacat ggcgaggaaa taaatcatat aaaaaatgat
148501 ttcatgatta aaccatgttg tgaaaaagtc aagaacgttc acattggcgg acaatctaaa
148561 aacaatacag tgattgcaga tttgccatat atggataatg cggtatccga tgtatgcaat
148621 tcactgtata aaaagaatgt atcaagaata tccagatttg ctaatttgat aaagatagat
```

FIG. 22 (CONT.)

```
148681 gacgatgaca agactcctac tggtgtatat aattatttta aacctaaaga tgccattcct
148741 gttattatat ccataggaaa ggatagagat gtttgtgaac tattaatctc atctgataaa
148801 gcgtgtgcgt gtatagagtt aaattcatat aaagtagcca ttcttcccat ggatgtttcc
148861 tttttacca aaggaaatgc atcattgatt attctcctgt ttgatttctc tatcgatgcg
148921 gcacctctct taagaagtgt aaccgataat aatgttatta tatctagaca ccagcgtcta
148981 catgacgagc ttccgagttc caattggttc aagttttaca taagtataaa gtccgactat
149041 tgttctatat tatatatggt tgttgatgga tctgtgatgc atgcaatagc tgataataga
149101 acttacgcaa atattagcaa aaatatatta gacaatacta caattaacga tgagtgtaga
149161 tgctgttatt ttgaaccaca gattaggatt cttgatagag atgagatgct caatggatca
149221 tcgtgtgata tgaacagaca ttgtattatg atgaatttac ctgatgtagg cgaatttgga
149281 tctagtatgt tggggaaata tgaacctgac atgattaaga ttgctctttc ggtggctggt
149341 atttggaaag ttttataggt agttgataga acaaaataca taattttgta aaaataaatc
149401 acttttata ctaatatgac acgattacca atacttttgt tactaatatc attagtatac
149461 gctacacctt ttcctcagac atctaaaaaa ataggtgatg atgcaacttt atcatgtaat
149521 cgaaataata caaatgacta cgttgttatg agtgcttggt ataaggagcc caattccatt
149581 attcttttag ctgctaaaag cgacgtcttg tattttgata attataccaa ggataaaata
149641 tcttacgact ctccatacga tgatctagtt acaactatca caattaaatc attgactgct
149701 agagatgccg gtacttatgt atgtgcattc tttatgacat cgcctacaaa tgacactgat
149761 aaagtagatt atgaagaata ctccacagag ttgattgtaa atacagatag tgaatcgact
149821 atagacataa tactatctgg atctacacat tcaccggaaa ctagttctga gaaacctgat
149881 tatatagata attctaattg ctcgtcggta ttcgaaatcg cgactccgga accaattact
```

FIG. 22 (CONT.)

```
149941 gataatgtag aagatcatac agacaccgtc acatacacta gtgatagcat taatacagta
150001 agtgcatcat ctggagaatc cacaacagac gagactccgg aaccaattac tgataaagaa
150061 gaagatcata cagttacaga cactgtctca tacactacag taagtacatc atctggaatt
150121 gtcactacta aatcaaccac cgatgatgcg gatctttatg atacgtacaa tgataatgat
150181 acagtaccat caactactgt aggcggtagt acaacctcta ttagcaatta taaaaccaag
150241 gactttgtag aaatatttgg tattaccgca ttaattatat tgtcggccgt ggcaatattc
150301 tgtattacat attatatata taataaacgt tcacgtaaat acaaaacaga gaacaaagtc
150361 tagatttttg acttacataa atgtctggga tagtaaaatc tatcatattg agcgggccat
150421 ctggtttagg aaagacagcc atagccaaaa gactatggga atatatttgg atttgtggtg
150481 tcccatacca ctagatttcc tcgtcctatg gaacgagaag gtgtcgatta ccattacgtt
150541 aacagagagg ccatctggaa gggaatagcc gccggaacat actgagtttt taggaaatat
150601 ttacggaact tctaaaactg ctgtgaatac agcggctatt aataatcgta tttgtgtgat
150661 ggatctaaac atcgacggtg ttagaagttt taaaaatact tacctaatgc cttactcggt
150721 gtatataaga cctacctctc ttaaaatggt tgagaccaag cttcgttgta gaaacactga
150781 agcggatgat gagattcatc gtcgtgtgat gttggcaaaa actgacatgg atgaggcagg
150841 tgaagccggt ctattcgaca ctattatcat tgaagatgat gtgaatttag catatagtaa
150901 gttaattcag atactacagg accgtattag aatgtatttt aacactaatt agagacttaa
150961 gacttaaaac ttgataatta ataatataac tcgtttttat atgtggctat ttcaacgtct
151021 aatgtattag ttaaatatta aaacttacca cgtaaaactt aaaatttaaa atgatatttc
151081 attgacagat agatcacaca ttatgaactt tcaaggactt gtgttaactg acaattgcaa
151141 aaatcaatgg gtcgttggac cattaatagg aaaaggtgga tttggtagta tttatactac
```

FIG. 22 (CONT.)

```
151201 taatgacaat aattatgtag taaaaataga gcccaaagct aacggatcat tatttaccga
151261 acaggcattt tatactagag tacttaaacc atccgttatc gaagaatgga aaaaatctca
151321 caatataaag cacgtaggtc ttatcacgtg caaggcattt ggtctataca aatccattaa
151381 tgtggaatat cgattcttgg taattaatag attaggtgca gatctagatg cggtgatcag
151441 agccaataat aatagattac caaaaaggtc ggtgatgttg atcggaatcg aaatcttaaa
151501 taccatacaa tttatgcacg agcaaggata ttctcacgga gatattaaag cgagtaatat
151561 agtcttggat caaatagata agaataaatt atatctagtg gattacggat tggtttctaa
151621 attcatgtct aatggcgaac atgttccatt tataagaaat ccaaataaaa tggataacgg
151681 tactctagaa tttacaccta tagattcgca taaaggatac gttgtatcta gacgtggaga
151741 tctagaaaca cttggatatt gtatgattag atggttggga ggtatcttgc catggactaa
151801 gatatctgaa acaaagaatt gtgcattagt aagtgccaca aaacagaaat atgttaacaa
151861 tactgcgact ttgttaatga ccagtttgca atatgcacct agagaattgc tgcaatatat
151921 taccatggta aactctttga catattttga ggaacccaat tacgacaagt ttcggcacat
151981 attaatgcag ggtgtatatt attaagtgtg gtgtttggtt gatgtaaaat ttttgtcgat
152041 aaaaattaaa aaataactta atttattatt gatctcgtgt gtacaaccga aatcatggcg
152101 atgttttacg cacacgctct cggtgggtac gacgagaatc ttcatgcctt tcctggaata
152161 tcatcgactg ttgccaatga tgtcagttta taataacaag tatgacattg taaaagacaa
152221 atatatgtgg tgttacagtc aggtgaacaa gagatatatt ggagcactgc tgcctatgtt
152281 tgagtgcaat gaatatctac aaattggaga tccgatccat gatcaagaag gaaatcacat
152341 atcgccacaa aaactactat gctctaagcg gaatcgggta cgagagtcta gacttgtgtt
```

FIG. 22 (CONT.)

```
152401 tggaaggagt agggattcat catcacgtac ttgaaacaga aaacgctgta tatggaaaag
152461 ttcaacatga ttattctact atcaaagaga aggccaaaga aatgaatgca ctcagttcag
152521 gacctatcat cgattaccac gtctggatag gagattgtat ctgtcaagtt actgctgtgg
152581 acgtacatgg aaaggaaatt atgagaatga gattcaaaaa gggtgcggtg cttccgatcc
152641 caaatctggt aaaagttaaa cttggggaga atgatacaga aaatctttct tctactatat
152701 cggcggcacc atcgaggtaa ccacctctct ggaagacagt gtgaatcatg tactcatgaa
152761 acgtttggaa tctatacgcc atatgtggtc tgttgtatat gatcattttg atattgtgaa
152821 tggtaaagaa tgctgttatg tgcatacgca tttgtctaat caaaatctta taccgagtac
152881 tgtaaaaaca aatttgtaca tgaagactat gggatcatgc attcaaatga gtatcttagc
152941 gaactgaagg aatcaggtgg atggagtccc agaccagaaa tgcaggaatt tgaatatcca
153001 gatggagtgg aagacactga atcaattgag agattggtag aggagttctt caatagatca
153061 gaacttcagg ctggtaaatc tattaatgtt aaacatacat ctgtttcagc taagcaacta
153121 agaacacgta tactctcatc ttttgccaac acagagggtg gatatttgtt cattggagtt
153181 gataataata cacacaaagt atttggattc acggtgggtt acgactacct cagactgata
153241 gagaatgata tagaaaagca tatcaaaaga ctttgtgttg tgtatttctg tgagaagaaa
153301 gaggacatca agtacacgtg tcgattcatc aaggtatata aacctgggga tgaggctacc
153361 tcgacatacg tgtgcgctat caaagtggaa agatgctgtt gtgctgtgtt tgcagattgg
153421 ccagaatcat ggtatcaaga agtattctcc agatgaatag gtgtcacata taaaatttta
153481 attaatgtaa ctatagagaa caaataatag gttgtaatat catatagaca ataactaaca
153541 attaattagt aactgttatc tctttttaac taactaacta tacctattaa tacatcgtaa
153601 ttatagttct taacatctat taatcattga ttcgcttctt taattttta taaaccaaca
```

FIG. 22 (CONT.)

153661 ttgttaattg aaaagggata acatgttaca gaatataaat tatatatgga ttttttttaa
153721 aaaggaaata cttgactgga gtgtatattt atctcttcat tatatagcac gcgtgttttc
153781 caatttttcc acatcccata taatacagga ttataatctc gttcgaacat acgagaaagt
153841 ggataaaaca atagttgatt ttttatctag gttgccaaat ttattccata ttttagaata
153901 tggggaaaat attctacata tttattctat ggatgatgct aatacgaata ttataatttt
153961 ttttctagat agagtattaa atattaataa gaacgggtca tttatacaca atctcaggtt
154021 atcatcatcc attaatataa aagaatatgt atatcaatta gttaataatg atcatccaga
154081 taataggata agactaatgc ttgaaaatgg acgtagaaca agacattttt tgtcctatat
154141 atcagataca gttaatatct atatatgtat tttatataga tgccgaagac agttacggtt
154201 gtacattatt acatagatgt atatatcact ataagaaatc agaatcagaa tcagaatcat
154261 acaatgaatt aattaagata ttgttaaata atggatcaga tgtagataaa aaagatacgt
154321 acggaaacac accttttatc ctattatgta aacacgatat caacaacgtg gaattgtttg
154381 agatatgttt agagaatgct aatatagact ctgtagactt taatagatat acacctcttc
154441 attatgtctc atgtcgtaat aaatatgatt ttgtaaagtt attaatttct aaaggagcaa
154501 atgttaatgc gcgtaataaa ttcggaacta ctccatttta ttgtggaatt atacacggta
154561 tctcgcttat aaaactatat ttggaatcag acacagagtt agaaatagat aatgaacata
154621 tagttcgtca tttaataatt tttgatgctg ttgaatcttt agattatcta ttatccagag
154681 gagttattga tattaactat cgtactattt acgacgctgt cagttataat gcgtataata
154741 cgttggtcta tctattaaac agaaatggtg attttgagac gattactact agtggatgta
154801 catgtatttc ggaagcagtc gcaaacaaca acaaaataat aatggaagta ctattgtcta
154861 aacgaccatc tttgaaaatt atgatacagt ctatgatagc aattactaaa cataaacagc

FIG. 22 (CONT.)

```
154921 ataatgcaga tttattgaaa atgtgtataa aatatactgc gtgtatgacc gattatgata
154981 ctcttataga tgtacaatca ctacagcaat ataaatggta tattttaaga tgtttcgatg
155041 aaatagatat catgaagaga tgttatataa aaaataaaac tgtattccaa ttagtttttt
155101 gtatcaaaga cattaatact ttaatgagat acggtaaaca tccttctttc gtgaagtgca
155161 ctagtctcga cgtatacgga agtcgtgtac gtaatatcat agcatctatt agatatcgtc
155221 agagattaat tagtctatta tccaagaagc tggatcctgg agataaatgg tcgtgttttc
155281 ctaacgaaat aaaatataac gataacgaac tgtccacata tctaaaaatc ttataaacac
155341 tattaaaata taaaatcaca ctacatcatt gtttcctttt agtgctcgac agtgtatact
155401 atttttaacg ctcataaata aaaatgaaaa cgatttccgt tgttacgttg ttatgcgtac
155461 tacctgctgt tgtttattca acatgtactg tacccactat gaataacgct aaattaacgt
155521 ctaccgaaac atcgtttaat aataaccaga aagttacgtt tacatgtgat cagggatatc
155581 attcttcgga tccaaatgct gtctgcgaaa cagataaatg gaaatacgaa aatccatgca
155641 aaaaaatgtg cacagtttct gattacatct ctgaactata taataaaccg ctatacgaag
155701 tgaattccac catgacacta agttgcaacg gcgaaacaaa atattttcgt tgcgaagaaa
155761 aaaatggaaa tacttcttgg aatgatactg ttacgtgtcc taatgcggaa tgtcaacctc
155821 ttcaattaga acacggatcg tgtcaaccag ttaaagaaaa atactcattt ggggaatata
155881 taactatcaa ctgtgatgtt ggatatgagg ttattggtgc ttcgtacata agttgtacag
155941 ctaattcttg gaatgttatt ccatcatgtc aacaaaaatg tgatataccg tctctatcta
156001 atggattaat ttccggatct acattttcta tcggtggcgt tatacatctt agttgtaaaa
156061 gtggttttat actaacggga tctccatcat ccacatgtat cgacggtaaa tggaatccca
```

FIG. 22 (CONT.)

```
156121 tactcccaac atgtgtacga tctaacgaaa aatttgatcc agtggatgat ggtcccgacg
156181 atgagacaga tttgagcaaa ctctcgaaag acgttgtaca atatgaacaa gaaatagaat
156241 cgttagaagc aacttatcat ataatcatag tggcgttaac aattatgggc gtcatatttt
156301 taatctccgt tatagtatta gtttgttcct gtgacaaaaa taatgaccaa tataagttcc
156361 ataaattgct accgtgaata taaatccgtt aaaataatga ataattaata attaataatt
156421 taataacaaa caagtatcaa aagattaaag acttatagct agaatcaatt gagatgtctt
156481 cttcagtgga tgttgatatc tacgatgccg ttagagcatt tttactcagg cactattata
156541 acaagagatt tattgtgtat ggaagaagta acgccatatt acataatata tacaggctat
156601 ttacaagatg cgccgttata ccgttcgatg atatagtacg tactatgcca aatgaatcac
156661 gtgttaaaca atgggtgatg gatacactta atggtataat gatgaatgaa cgcgatgttt
156721 ctgtaagcgt tggcaccgga atactattca tggaaatgtt tttcgattac aataaaaata
156781 gtatcaacaa tcaactaatg tatgatataa ttaatagcgt atctataatt ctagctaatg
156841 agagatatag aagcgctttt aacgacgatg gtatatacat ccgtagaaat atgattaaca
156901 agttgtacgg atacgcatct ctaactacta ttggcacgat cgctggaggt gtttgttatt
156961 atctgttgat gcatctagtt agtttgtata aataattatt tcaatatact agttaaaatt
157021 ttaagatttt aaatgtataa aaaactaata acgtttttat ttgtaatagg tgcattagca
157081 tcctattcga ataatgagta cactccgttt aataaactga gtgtaaaact ctatatagat
157141 ggagtagata atatagaaaa ttcatatact gatgataata atgaattggt gttaaatttt
157201 aaagagtaca caatttctat tattacagag tcatgcgacg tcggatttga ttccatagat
157261 atagatgtta taaacgacta taaaattatt gatatgtcta ctattcaacg cagaggtcac
157321 acgtgtagaa tatctaccaa attatcatgc cattatgata agtaccctta tattcacaaa
```

FIG. 22 (CONT.)

157381 tatgatggtg atgagcgaca atattctatt actgcagagg gaaaatgcta taaaggaata
157441 aaatatgaaa taagtatgat caacgatgat actctattga gaaaacatac tcttaaaatt
157501 ggatctactt atatatttga tcgtcatgga catagtaata catattattc aaaatatgat
157561 ttttaaaaat ttaaaatata ttatcacttc agtgacagta gtcaaataac aaacaacacc
157621 atgagatata ttataattct cgcagttttg ttcattaata gtatacacgc taaaataact
157681 agttataagt ttgaatccgt caattttgat tccaaaattg aatggactgg ggatggtcta
157741 tacaatatat cccttaaaaa ttatggcatc aagacgtggc aaacaatgta tacaaatgta
157801 ccagaaggaa catacgacat atccgcattt ccaaagaatg atttcgtatc tttctgggtt
157861 aaatttgaac aaggcgatta taaagtggaa gagtattgta cgggaccacc gactgtaaca
157921 ttaactgaat acgacgacca tccgtatgct actagaggta gcaaaaagat tcctatttac
157981 aaacgcggtg acatgtgtga tatctacttg ttgtatacgg ctaacttcac attcggagat
158041 tctaaagaac cagtaccata tgatatcgat gactacgatt gcacgtctac aggttgcagc
158101 atagactttg tcacaacaga aaaagtgtgc gtgacagcac agggagccac agaagggttt
158161 ctcgaaaaaa ttactccatg gagttcgaaa gtatgtctga cacctaaaaa gagtgtatat
158221 acatgcgcaa ttagatccaa agaagatgtt cccaatttca aggacaaaat ggccagagtt
158281 atcaagagaa aatttaacta aatttctcgg tagcacatca aatgatgtta ccacttttct
158341 tagcatgctt aacttgacta aatattcata actaattttt attaatgata caaaaacgaa
158401 ataaaactgc atattataca ctggttaacg cccttatagg ctctaaccat tttcaagatg
158461 aggtccctga ttatagtcct tctgttcccc tctatcatct actccatgtc tattagacga
158521 tgtgagaaga ctgaagagga aacatgggga ttgaaaatag ggttgtgtat aattgccaaa
158581 gatttctatc ccgaaagaac tgattgcagt gttcatctcc caactgcaag tgaaggcaat

FIG. 22 (CONT.)

158641 ggattcaggg atatacgaaa caccgataaa ttataaaaaa agcaatgtgt ccgctgtttc
158701 cgttaataat actattttcg taactggcgg attattcata aataactcta atagcacgat
158761 cgtggttaac aatatggaaa aacttgacat ttataaagac aaacaatggt cgattataga
158821 aatgcctatg gctagggtat atcacggcat cgactcgaca tttggaatgt tatattttgc
158881 cggaggtcta tccgttaccg aacaatatgg taatttagag aaaaacaacg agatatcttg
158941 ttacaatcct agaacgaata agtggtttga tatttcatat actatttata agatatccat
159001 atcatcattg tgtaaactaa ataacgtctt ctatgtattt agtaaggaca ttggatatgt
159061 ggaaaagtat gatggtctcc ccgctataaa ggcattatca acttctcctt attgattgaa
159121 aatgaaaata taaatagttt ttatgtatag cagtattacc ctatagtttt attgcttact
159181 actaacatgg atacagatac agatgttaca aatgtagaag atatcatgaa tgaaatagat
159241 agagagaaag aagaaatact aaaaaatgta gaaattgaaa ataataaaaa cattaacaag
159301 aatcatccca atgaatatat tagagaagca ctcgttatta atacaagtag taatagtgat
159361 tccattgata aagaagttat agaatgtatc agtcacgatg taggaatata gatcatatct
159421 actaattttt ataatcaata caaaacataa aaaacaactc gttattacat agcaggcatg
159481 gaatccttca agtattgttt tgataacgat ggcaagaaat ggattatcgg aaatacttta
159541 tattctggta attcaatact ctataaggtc agaaaaaatt tcactagttc gttctacaat
159601 tacgtaatga agatagatca caaatcacac aagccattgt tgtctgaaat acgattctat
159661 atatctgtat tggatccttt gactatcgac aactggacac gggaacgtgg tataaagtat
159721 ttggctattc cagatctgta tggaattgga gaaaccgatg attatatgtt cttcgttata
159781 aagaatttgg gaagagtatt cgccccaaag gatactgaat cagtcttcga agcatgcgtc

FIG. 22 (CONT.)

```
159841 actatgataa acacgttaga gtttatacac tctcgaggat ttacccatgg aaaaatagaa
159901 ccgaggaata tactgattag aaataaacgt ctttcactaa ttgactattc tagaactaac
159961 aaactataca agagtggaaa ctcacatata gattacaacg aggacatgat aacttcagga
160021 aatatcaatt atatgtgtgt agacaatcat cttggagcaa cagtttcaaa acgaggagat
160081 ttagaaatgt tgggatattg catgatagaa tggttcggtg gcaaacttcc atggaaaaac
160141 gaaagtagta taaaagtaat aaaacaaaaa aaagaatata aaaaatttat agctactttc
160201 tttgaggact gttttcctga aggaaatgaa cctctggaat tagttagata tatagaatta
160261 gtatacacgt tagattattc tcaaactcct aattatgaca gactacgtag actgtttata
160321 caagattgaa atattctttt tttatagagt gtggtagtgt tacggatatc taatattaat
160381 attagactat ctctatcgcg ctacacgacc aatatcgatt actatggata tcttctatga
160441 aaggagagaa tgtattcatt tctccagcgt caatctcgtc agtattgaca atactgtatt
160501 atggagctaa tggatccact gctgaacagc tatcaaaata tgtagaaaag gaggagaaca
160561 cggataaggt tagcgctcag aatatctcat tcaaatccat gaataaagta tatgggcgat
160621 attctgccgt gtttaaagat tcctttttga gaaaaattgg cgataagttt caaactgttg
160681 acttcactga ttgtcgcact atagatgcaa tcaacaagtg tgtagatatc tttactgagg
160741 ggaaaatcaa tccactattg gatgaacaat tgtctcctag caattagtgc cgtatacttt
160801 aaagcaaaat ggttgacgcc attcgaaaag gaatttacca gtgattatcc cttttacgta
160861 tcaccaacgg aaatggtaga cgtaagtatg atgtctatgt acggcgagct atttaatcac
160921 gcatctgtaa aagaatcatt cggtaacttt tcaatcatag aactgccata tgttggagat
160981 actagtatga tggtcattct tccagacaag attgatggat tagaatccat agaacaaaat
161041 ctaacagata caaattttaa gaaatggtgt aactctctgg aagctacgtt tatcgatgtt
```

FIG. 22 (CONT.)

```
161101 cacattccca agtttaaggt aacaggctcg tataatctgg tggatactct agtaaagtca
161161 ggactgacag aggtgttcgg ttcaactgga gattatagca atatgtgtaa tttagatgtg
161221 agtgtcgacg ctatgatcca caaaacgtat atagatgtca atgaagagta tacagaagca
161281 gctgcagcaa cttgtgcact ggtgtcagac tgtgcatcaa caattacaaa tgagttctgt
161341 gtagatcatc cgttcatcta tgtgattagg catgttgatg gaaaaatttt tttcgttggt
161401 agatattgct ctccgacaac taattgttaa ccattttttt taaaaaaata gaaaaaacat
161461 gtggtattag tgcaggtcgt tattcttcca attgcaattg gtaagatgac ggccaacttt
161521 agtacccacg tcttttcacc acagcactgt ggatgtgaca gactgaccag tattgatgac
161581 gtcaaacaat gtttgactga atatatttat tggtcgtcct atgcataccg caacaggcaa
161641 tgcgctggac aattgtattc cacactcctc tcttttagag atgatgcgga attagtgttc
161701 atcgacattc gcgagctggt aaaaaatatg ccgtgggatg atgtcaaaga ttgtgtagaa
161761 atcatccgtt gttatatacc ggatgagcaa aaaaccatca tcggactttg tgcatatgct
161821 gctacttact ggggaggtga agaccatccc actagtaaca gtctgaacgc attgtttgtg
161881 atgcttgaga tgctaaatta cgtggattat aacatcatat tccggcgtat gaattgatga
161941 gttgtacatc ttgacatttt cttctttctt ctcttctccc tttcccagaa acaaactttt
162001 tttacccact ataaaataaa atgagtatac tacctgttat atttctttct atattttttt
162061 attcttcatt cgttcagact tttaacgcgc ctgaatgtat cgacaaaggg caatattttg
162121 catcattcat ggagttagaa aacgagccag taatcttacc atgtcctcaa ataaatacgc
162181 tatcatccgg atataatata ttagatattt tatggaaaaa acgaggagcg gataatgata
162241 gaattatacc gatagataat ggtagcaata tgctaattct gaacccgaca caatcagact
162301 ctggtattta tatatgcatt accacgaacg aaacctactg tgacatgatg tcgttaaatt
```

FIG. 22 (CONT.)

```
162361 tgacaatcgt gtctgtctca gaatcaaata tagatcttat ctcgtatcca caaatagtaa
162421 atgagagatc tactggcgaa atggtatgtc ccaatattaa tgcatttatt gctagtaacg
162481 taaacgcaga tattatatgg agcgggcatc gacgccttag aaataagaga cttaaacaac
162541 ggacacctgg aattattacc atagaagatg ttagaaaaaa tgatgctggt tattatacat
162601 gtgttttaga atatatatac ggtggcaaaa catataacgt aaccagaatt gtaaaattag
162661 aggtacggga taaaataata ccttctacta tgcaattacc agaaggtgtt gtaacttcaa
162721 taggtagtaa tttgactatt gcgtgtagag tatcgttgag acctcccaca acggatgcag
162781 acgtcttttg gataagtaat ggtatgtatt acgaagaaga tgatggggac ggagacggta
162841 gaataagtgt agcaaataaa atctatatga ccgataagag acgtgttatt acatcccggt
162901 taaacattaa tcctgtcaag gaagaagatg ctacaacgtt tacgtgtatg gcgtttacta
162961 ttcctagcat cagcaaaaca gttactgtta gtataacgtg aatgtatgtt gttacatttc
163021 catgtcaatt gagtttataa gaatttttat acattatctt ccaacaaaca attgacgaac
163081 gtattgctat gattaactcc cacgatacta tgcatattat taatcattaa cttgcagact
163141 atacctagtg ctattttgac atactcatgt tcttgtgtaa ttgcggtatc tatattatta
163201 aagtacgtaa atctagctat agttttatta tttaatttta gataatatac cgtctcctta
163261 tttttaaaaa ttgccacatc ctttattaaa tcatgaatgg gaatttctat gtcatcgtta
163321 atatattgtg aacaacaaga gcagatatct ataggaaagg gtggaatgcg atacattgat
163381 ctatgtagtt ttaaaacaca cgcgaacttt gaagaattta tataaatcat tccatcgata
163441 catccttcta tgttgacatg tatatatcca ggaattcttt tattaatgtc aggaaatgta
163501 taaactaaaa cattgcccga aagcggtgcc tctatctgcg ttatatccgt tcttaactta
```

FIG. 22 (CONT.)

```
163561 caaaatgtaa ccaatacctt tgcatgactt gttttgttcg gcaacgttag tttaaacttg
163621 acgaatggat taattacaat agcatgatcc gcgcatctat taagtttttt tactttaacg
163681 cccttgtatg tttttacaga gactttatct aaatttctag tgcttgtatg tgttataaat
163741 ataacgggat atagaactga atcacctacc ttagataccc aattacattt tatcagatcc
163801 agataataaa caaattttgt cgccctaact aattctatat tgttatatat tttacaattg
163861 gttatgatat catgtaataa cttggagtct aacgcgcatc gtcgtacgtt tatacaattg
163921 tgatttagtg tagtatatct acacatgtat ttttccgcac tatagtattc tggactagtg
163981 ataaaactat cgttatatct gtcttcaatg aactcatcga gatattgctc tctgtcatat
164041 tcatacacct gcataaactt tctagacatc ttacaatccg tgttatttta ggatcatatt
164101 tacatattta cgggtatatc aaagatgtta gattagttaa tgggaatcgt ctataataat
164161 gaatattaaa caattatatg aggactttta ccacaaagca tcataaaaat gagtcgtcgt
164221 ctgatttatg ttttaaatat caaccgcgaa tcaactcata aaatacaaga gaatgaaata
164281 tatacatatt ttagtcattg caatatagac catacttcta cagaacttga ttttgtagtt
164341 aaaaactatg atctaaacag acgacaacct gtaactgggt atactgcact acactgctat
164401 ttgtataata attactttac aaacgatgta ctgaagatat tattaaatca tggagtggat
164461 gtaacgatga aaaccagtag cggacgtatg cctgtttata tattgcttac tagatgttgt
164521 aatatttcac atgatgtagt gatagatatg atagacaaag ataaaaacca cttatcgcat
164581 agagactatt ccaacctact actagagtat ataaaatctc gttacatgtt attgaaggaa
164641 gaggatatcg atgagaacat agtatccact ttattagata agggaatcga tcctaacttt
164701 aaacaagacg gatatacagc gttacattat tattatttgt gtctcgcaca cgtttataaa
164761 ccaggtgagt gtagaaaacc gataacgata aaaaaggcca agcgaattat ttctttgttt
```

FIG. 22 (CONT.)

```
164821 atacaacatg gagctaatct aaacgcgtta gataattgtg gtaatacacc attccatttg
164881 tatcttagta ttgaaatgtg taataatatt catatgacta aaatgctgtt gacttttaat
164941 ccgaatttca aaatatgtaa taatcatgga ttaacgccta tactatgtta tataacttcc
165001 gactacatac aacacgatat tcttgttatg ttaatacatc actatgaaac aaatgttgga
165061 gaaatgccga tagatgagcg tcgtataatc gtattcgagt ttatcaaaac atattctaca
165121 cgtccggcag attcgataac ttatttgatg aataggttta aaaatataga tatttatacc
165181 cgctatgaag gaaagacatt attacacgta gcatgtgaat ataataatac acacgtaata
165241 gattatctta tacgtatcaa cggagatata aatgcgttaa ccgacaataa caaacacgct
165301 acacaactca ttatagataa caaagaaaat tccccatata ccattaattg tttactgtat
165361 atacttagat atattgtaga taagaatgtg ataagatcgt tggtggatca acttccatct
165421 ctacctatct tcgatataaa atcatttgag aaattcatat cctactgtat acttttagat
165481 gacacatttt acaatagaca cgttaggaat cgcaattcta aaacgtatcg atacgcattt
165541 tcaaaataca tgtcgtttga taaatacgat ggtataataa ctaaatgtca taaagaaaca
165601 atattgctca aactatccac tgttctagac actacactat atgcagtttt aagatgccat
165661 aattcgaaaa agttaagaag atacctcaac gagttaaaaa aatataataa cgataagtcc
165721 tttaaaatat attctaatat tatgaatgag agatacctta atgtatatta taaagatatg
165781 tacgtgtcaa aggtatatga taaactattt cctgttttca cagataaaaa ttgtctacta
165841 acattactac cttcagaaat tatatacgaa atattataca tgctgacaat taacgatctt
165901 tataatatat cgtatccacc taccaaagta tagttgtatt tttctcatgc gatgtgtgta
165961 aaaaaactga tattatataa atattttagt gccgtataat gaagatgacg atgaaaatga
166021 tggtacatat atatttcgta tcattattgt tattgctatt ccacagttac gccatagaca
```

FIG. 22 (CONT.)

```
166081 tcgaaaatga aatcacagaa ttcttcaata aaatgagaga tactctacca gctaaagact
166141 ctaaatggtt gaatccagca tgtatgttcg gaggcacaat gaatgatata gccgctctag
166201 gagagccatt cagcgcaaag tgtcctccta ttgaagacag tcttttatcg cacagatata
166261 aagactatgt ggttaaatgg gagaggctag aaaaaaatag acggcgacag gtttctaata
166321 aacgtgttaa acatggtgat ttatggatag ccaactatac atctaaattc agtaaccgta
166381 ggtatttgtg taccgtaact acaaagaatg gtgactgtgt tcagggtata gttagatctc
166441 atattaaaaa acctccttca tgcattccaa aaacatatga actaggtact catgataagt
166501 atggcataga cttatactgt ggaattcttt acgcaaaaca ttataataat ataacttggt
166561 ataaagataa taaggaaatt aatatcgacg atattaagta ttcacaaacg ggaaagaaat
166621 taattattca taatccagag ttagaagata gtggaagata caactgttac gttcattacg
166681 acgacgttag aatcaagatg taaaatactt acggttatac cgtcgcaaga ccacaggttt
166741 aaactaatac tagatccaaa aatcaacgta acgataggag aacctgccaa tataacatgc
166801 actgctgtgt caacgtcatt attgattgac gatgtactga ttgaatggga aaatccatcc
166861 ggatggctta taggattcga ttttgatgta tactctgttt taactagtag aggcggtatc
166921 accgaggcga ccttgtactt tgaaaatgtt actgaagaat atataggtaa tacatataaa
166981 tgtcgtggac acaactatta ttttgaaaaa acccttacaa ctacagtagt attggagtaa
167041 atacacaatg cattttttata tacattactg aataattatt attattattt atatcgtatt
167101 tgtgctataa cgcgactatc taggtatttg tatctcaccg atagagaaca tataaatgta
167161 gactctatta aacagttgtg taaaatatca gatcctaata gatgtggatg tacggcttta
167221 gaaatgagtt cattaaaata tgtgatatca acggaacata tttatataat tatactattg
```

FIG. 22 (CONT.)

```
167281 ctgttagtat aattattgat tccacggaag aactaccaac agttactcca attacaacaa
167341 catataatta tactatcgat gatagcacta ctgaagaact acaagtgact cctcatatgg
167401 atctccatcg atgatacatg tattaaaata ctttccgaat aagtctttta aatattgtat
167461 taattatgaa aaactatgct atgcgagtat gatacgatac tagattttat ctctagcgag
167521 agatgtcgtt agaatcattt atcaacgaat atcgataaca tgtgtcattt atacgttaaa
167581 gtctgtccgt cttctctatt gtttagactg tttgtagaat gctgtgatat aaacaaacta
167641 gtagacacaa atatttaact catgatgaag ttgagaatga tatgctttag ctaatataaa
167701 aatatattaa tccactatat attctagact tgatttaaaa ccgataaact actactacgt
167761 actgtataag ttaggagcag accctaatta tgtagatgat agaggtaata cttctgcatc
167821 tatatgtcca cttatgagaa aacgtcattt aataagatgc atcgtgaaaa gaaatttatt
167881 aaagagttgg taaaatatga aaccgaaagt aaataatata ggaaatacac ctctacataa
167941 ctacgtatct caatatgata tcactctcat tcctcatcca caacccatta aaaaatggaa
168001 attaaagccc tctattagca taaacggcta caggtctacc tttacaatgg cctttccttg
168061 tgcccagttc agaccctgtc attgccacgc tactaaggac tccctgaata ccgtggccga
168121 cgtcagacat tgtctgactg aatacatcct gtgggtttct catagatgga cccatagaga
168181 aagcgcaggg tctctctaca ggcttctcat ctctttcaga actgatgcaa cggagctctt
168241 tggtggtgag ttgaaggatt cacttccgtg gagatcatta aatgactcca tgaaaaccgc
168301 cgaagaactt cgtgcaatca ttggactttg tactcaatca gctatcgtct ctggaagagt
168361 cttcaacgat aagtatatcg acatactact tatgctgcga aagattctga acgagaacga
168421 ctatctcacc ctcttggatc atatccgcac tgctaaatac taaatctcct tcatgctctc
168481 tcactacact ttttatcatc ttatgaggaa taattagcac cagaatagct atggattgca
```

FIG. 22 (CONT.)

```
168541 catgtattct atgtcgtcta ctggatgaag atgtgacgta caaaaaaata aaactagaaa
168601 ttgaaacgtg tcacaactta tcaaaacata tagatagacg aggaaacaat gcgctacatt
168661 gttacgtctc caataaatgc gatacagaca ttaagattgt tcgactgtta ctctctcgcg
168721 gagtcgagag actttgtaga aacaacgaag gattaactcc gctaggagca tacagtaagc
168781 atagatacgt aaaatctcag attgtgcatc tactgatatc cagctattcg aattcctcta
168841 acgaactcaa gtcgaatata aatgatttcg acttacgtct gctaaaatac ctaattgtgg
168901 ataaacggat acgtccgtcc aagaatacga attatgcaat caatggtctc ggattggtgg
168961 atatatacgt aacgacgcct aatccgagac cagaagtatt gctatggctt cttaaatcag
169021 aatgttacag caccggttac gtatttcgta cctgtatgta caacagtgat atgtgtaaga
169081 actctcttca ttactatata tcgtctcata gagaatctct atccaaggat gtaattaaat
169141 gtttgatcga taacaatgtt tccatccaat actactggtc ttgctcaacc atagatatag
169201 agattattaa taaaggatgt ggacacgtgt agagtatacg acgtcagccc tatattagag
169261 gcgtattatc taaacaagcg atttagagta accccatata atgtagacat ggaaatcgtt
169321 aatcttctta ttgagagacg tcatactctt gtcgacgtaa tgcgtagtat tacttcgtac
169381 gattccagag aatataacca ctacatcatc gataacattc taaagagatt tagacaacag
169441 gatgaatcca tcgtacaagc catactgata aactacttac attacggcga tatggtaagt
169501 atacctatca ttcaatgcat gttggataag acgacggaca acaactttgt taataataat
169561 ctcgtcgatg taaacgtcgt aaggtttatc gtggaaaata tggacacgcg gctgtaaatc
169621 acatatctaa caatggccgt ctatgtatgt acggtctgat attatcgaga tttaataatt
169681 gcgggtatca ctgttatgaa gatgtatttg atatactaag caagtacatg gatgatatag
169741 atatgatcga taactctact atattacgcg gtcgatgtca ataatataca atttgcaaag
```

FIG. 22 (CONT.)

```
169801 cggttattgg aatatggagc gagtgtcacg ctcgataatc aatacggcca tccagaaaag
169861 cagttaccaa agagaagcta gttgatttat tactgagtta ccatcccact ctagagacta
169921 tgattgacgc atttaataga gatatacgct atctatatcc tgaaccatta ttcgcctgta
169981 tcagatacgc cttaatccta gatgatgatt ttccttctaa agtaagtatg atatcgccgg
170041 tcgtcataag gaactaaagc gctatagagc agacattaat agaatgaaga atgcctacat
170101 atcaggcgtc tccatgtttg atatattatt taaacgaagc aaacgccaca gattgagata
170161 cgcaaagaac aatgagagga tcgactccat taaataattt atcatggagt gataatgtcc
170221 tgtttccatg gcatattaca aaatcgattc cgtccaagat gataaaaaca tttaccggca
170281 tcataaacac ggagtttatt ttatatgtct cgcataaaca ttactaaaaa aatatattgt
170341 tcggttttct ttcacatctt taattatgaa aaagtaaatc attatgagat ggacgcatcg
170401 ttcgcgacag tatgtggtac atacctaacg tatttatgga cgacggtaag aatgaaggtc
170461 acgtttctgt caacaatgtc gacgcgatcg tgtaacacga ctcacaatag aatctgtgaa
170521 tgctctcccg atcatggatg caaggcatgt gtttcccaaa caaaatgtgg aataggatac
170581 ggagtatccg gagacgtcat ctgttctccg tgtggtctcg gaacatattc tcacaccgtc
170641 tcttccgcag ataaatgcga acccgtaccc agaaatacct ttaactatat cgatgtggaa
170701 attaacctgt atccagttaa cgacacatcg tgtactcgga cgaccactac cggtctcagc
170761 gaatccatct caacgtcgga actaactatt actatgaatc ataaagactg cgatcccgtc
170821 ttcttaataa ggtagcgact tcaggtttct ttacaggaga aaggtgtgca ctctgaattt
170881 cgagattaaa tgcaataaca aagattcttc ctccaaacag ttaacgaaag caaagaatga
170941 tactatcatg ccgcattcgg agacagtaac tctagcgtcg acatctatat actatatagt
```

FIG. 22 (CONT.)

```
171001 aataccaata ctcaagacta cgaaactgat acaatctctt atcatgtggg taatgtagcc
171061 atatgcccgg tagttgcgat atacataaac tgatcactaa ttccaaaccc acccgctttt
171121 tatagtaagt ttttcaccca taaatacaat aattaatttc tcgtaaaagt agaaaatata
171181 ttctaattta ttgcacggta aggaagtaga atcataaaga acagtactca atcaatagca
171241 atcatgaaac aatatatcgt actggcatgc atgtgcctgc cagtcttcag caatcatcct
171301 catcgtgtac ggaagaagaa aacaaacatc atatgggaat cgatgttatt atcaaagtca
171361 caaagcaaga ccaaacaccg accgatgata agatttgcca atccgtaacg gaaattacag
171421 agtccgagtc agatccagat cccgaggtgg aatcagtcga ggatgtagat cctcctacca
171481 cttattactc catcatcggt ggaggtctga gaatgaactt tggattcacc aaatgtcctc
171541 agattaaatc catctcagaa tccgctgatg gaaagactgt gaggtgtcta tcgacatcag
171601 atgtagcgaa gaagagaaag acagcgacat caagacccat ccagtactcg ggtctaacat
171661 ctctcataag aaagtgagtt acgaagatat catcggttca acgatcgtcg atacaaaatg
171721 tgtcaagaat ctagagttta gcgttcgtat cggagacatg tgcaaggaat catctgaact
171781 tgaggtcaag tatgtcgacg gatcggcatc tgaaggtgca accgatgata cttcactcat
171841 cgattcaaca aaactcaaag cgtgtgtctg aatcgataac tctattcatc tgaaattgga
171901 tgagtagggt taatcgaacg attcaggcac accacgaatt aaaaaagtgt accggacact
171961 atattccggt ttgcaaaaca aaaagttacc tctcgcgact tcttcttttt ctgtctcaat
172021 agtgtgatac gattatgaca ctattcctat ttcctttcag ggtatcacaa aaatattaaa
172081 cctctttctg atggtctcat acaaaaatat ttttattctc tttctctctt tgatggtctc
172141 ataaaaaata tttttattct ctttctctct ttgatggtct cataaaatat ttttattctc
172201 tttctctctt tgatggtctc ataaaaaata tttttattct ctttctctct ttgatggtct
```

FIG. 22 (CONT.)

```
172261 cataaaatat ttttattctc tttctctctt tgatggtctc ataaaaaata tttttattct
172321 ctttctctct ttgatggtct cataaaaaat attaaacctc tttctgatgg tgtcactaaa
172381 atatttttat tctctttctc tcttcaatgg agtcataaaa tatttttatt ctctttctct
172441 cttcgatggt ctcacaaaaa tattaaacct ctttctgatg gtgtcactaa aatattttta
172501 ttctctttct ctcttcaatg gagtcataaa atatttttat tctctttctc tctttgatgg
172561 tctcacaaaa atatttttat tctctttctc tctttgatgg tctcacaaaa atatttttat
172621 tctctttctc tctttgatgg tctcacaaaa atatttttat tctctttctc tctttgatgg
172681 tctcataaaa aaagttttac aaaaatattt ttattctctt tctctctttg atggtctcat
172741 aaaaaaagtt ttacaaaaat atttttattc tctttctctc tttgatggtc tcataaaaaa
172801 agttttacaa aaatattttt attctctttc tctctttgat ggtctcataa aaaatattaa
172861 acctctttct gatggtgtca ctaaaatatt tttattctca ttctctcttc aatggagtca
172921 taaaatattt ttattctctt tctctcttcg atggtctcac aaaaatatta aacctctttc
172981 tgatggtgtc actaaaatat ttttattctc attctctctt caatggagtc ataaaatatt
173041 tttattctct ttctctcttc gatggtctca caaaaatatt aaacctcttt ctgatggtgt
173101 cactaaaata tttttattct cattctctct tcaatggagt cataaaatat ttttattctc
173161 tttctctctt tgatggtctc ataaaaaaag ttttacaaaa atatttttat tctctttctc
173221 tctttgatgg tctcataaaa aatattaaac ctctttctga tggtgtcact aaaatatttt
173281 tattctcttt ctctcttcaa tggagtcata aaatattttt attctctttc tctcttcgat
173341 ggtctcacaa aaatattaaa cctctttctg atggtgtcac taaaatattt ttattctcat
173401 tctctcttca atggagtcat aaaatatttt tattctcttt ctctctttga tggtctcata
173461 aaaaaagttt tacaaaaata tttttattct ctttctctct ttgatggtct cataaaaaaa
```

FIG. 22 (CONT.)

```
173521 gttttacaaa aatattttta ttctctttct ctctttgatg gtctcataaa aaaagtttta
173581 caaaaatatt tttattctct ttctctcttt gatggtctca taaaaaaagt tttacaaaaa
173641 tatttttatt ctctttctct ctttgatggt ctcataaaaa atattaaacc tctttctgat
173701 ggtgtcacta aaatattttt attctcattc tctcttcaat ggagtcataa aatattttta
173761 ttctctttct ctcttcgatg gtctcacaaa aatattaaac ctctttctga tggtgtcact
173821 aaaatatttt tattctcatt ctctcttcaa tggagtcata aaatattttt attctctttc
173881 tctctttgat ggtctcataa aaaaagtttt acaaaaatat ttttattctc tttctctctt
173941 tgatggtctc ataaaaaaag ttttacaaaa atatttttat tctctttctc tctttgatgg
174001 tctcataaaa aaagttttac aaaaatattt ttattctctt tctctctttg atggtctcat
174061 aaaaaaagtt ttacaaaaat atttttattc tctttctctc tttgatggtc tcacaaaaat
174121 attaaacctc tttctgatgg agtcgtaaaa aagttttatc tctttctcct tcgatggtct
174181 cacaaaaata ttaaacctct ttctgatgga gtcgtaaaaa agttttatct ctttctctct
174241 tcgatggtct cacaaaaata ttaaacctct ttctgatgga gtcgtaaaaa agttttatct
174301 ctttctctct tcgatggtct cactaaaata ttttttattc tctttctgat gcatcaacta
174361 tttcttaaac aataacgtcc aacaacatat actcgtcgag cttatcaaca tcccctatgc
174421 ccatctaggt taccagacaa ttgtatatca taaaataatg tttataattt ttacaaaaat
174481 atttttattc tctttctctc tttgatggtc tcataaaaaa agttttacaa aaatattttt
174541 attctctttc tctctttgat ggtctcataa aaaatattaa acctctttct gatggtgtca
174601 ctaaaatatt tttattctca ttctctcttc aatggagtca taaaatattt ttattctctt
174661 tctctcttcg atggtctcac aaaaatatta aacctctttc tgatggtgtc actaaaatat
```

FIG. 22 (CONT.)

```
174721 ttttattctc attctctctt caatggagtc ataaaatatt tttattctct ttctctcttt
174781 gatggtctca taaaaaaagt tttacaaaaa tatttttatt ctctttctct ctttgatggt
174841 ctcataaaaa aagttttaca aaaatatttt tattctcttt ctctctttga tggtctcata
174901 aaaaaagttt tacaaaaata tttttattct ctttctctct ttgatggtct cataaaaaaa
174961 gttttacaaa aatattttta ttctctttct ctctttgatg gtctcataaa aaaagtttta
175021 caaaaatatt tttattctct ttctctcttt gatggtctca taaaaaaagt tttacaaaaa
175081 tatttttatt ctctttctct ctttgatggt ctcataaaaa aagttttaca aaaatatttt
175141 tattctcttt ctctctttga tggtctcata aaaaatatta aacctctttc tgatggtgtc
175201 actaaaatat ttttattctc tttctctctt caatggagtc ataaaatatt tttattctct
175261 ttctctcttc gatggtctca caaaaatatt aaacctcttt ctgatggtgt cactaaaata
175321 tttttattct cattctctct tcaatggagt cataaaatat ttttattctc tttctctctt
175381 tgatggtctc ataaaaaaag ttttacaaaa atatttttat tctctttctc tctttgatgg
175441 tctcataaaa aaagttttac aaaaatattt ttattctctt tctctctttg atggtctcat
175501 aaaaaaagtt ttacaaaaat atttttattc tctttctctc tttgatggtc tcataaaaaa
175561 agttttacaa aaatattttt attctctttc tctctttgat ggtctcataa aaaaagtttt
175621 acaaaaatat ttttattctc tttctctctt tgatggtctc ataaaaaata ttaaacctct
175681 ttctgatggt gtcactaaaa tatttttatt ctctttctct cttcaatgga gtcataaaat
175741 atttttattc tctttctctc ttcgatggtc tcacaaaaat attaaacctc tttctgatgg
175801 tgtcactaaa atatttttat tctctttctc tcttcaatgg agtcataaaa tatttttatt
175861 ctctttctct ctttgatggt ctcataaaaa aagttttaca aaaatatttt tattctcttt
175921 ctctctttga tggtctcata aaaaaagttt tacaaaaata tttttattct ctttctctct
```

FIG. 22 (CONT.)

```
175981 ttgatggtct cataaaaaaa gttttacaaa aatattttta ttctctttct ctctttgatg
176041 gtctcataaa aaaagtttta caaaaatatt tttattctct ttctctcttt gatggtctca
176101 taaaaaaagt tttacaaaaa tatttttatt ctctttctct ctttgatggt ctcataaaaa
176161 aagttttaca aaaatatttt tattctcttt ctctctttga tggtctcata aaaaaagttt
176221 tacaaaaata tttttattct ctttctctct ttgatggtct cataaaaaat attaaacctc
176281 tttctgatgg tgtcactaaa atatttttat tctcatttc tctttctctc ttcaatggag
176341 tcataaaata tttttattct ctttctctct ttgatggtct cataaaaaat attaaacctc
176401 tttctgatgg tgtcactaaa atatttttat tctcattctc tcttcaatgg agtcataaaa
176461 aagttttatc tctttctctc ttcgatggtc tcacaaaaat attaaacctc tttctgatgg
176521 agtcgtaaaa aagttttatc tctttctctc ttcgatggtc tcacaaaaat attaaacctc
176581 tttctgatgc atcaactatt tcttaaacaa taacgtccaa caacatatac tcatccccta
176641 tgcccatcta ggttaccaga caattgtata tcataaaata atgtttataa tttacacgtt
176701 aaaatcatat aataaaacgt agatcgtata atatttttg gtatataaat gatctagtaa
176761 aatccatgta ggggatactg ctcacatttt ttctttggta caaaatttca cacaagtttt
176821 tatacagaca aattcttgtc catatatttt aaaacattga cttttgtact aagaaaaata
176881 tctagactaa ctatctcttt ctctttctct cttcgatggt ctttctgatg gagtcgtaaa
176941 aaagttttat ctctttctct cttcgatggt ctcacaaaaa tattaaacct ctttctgatg
177001 gagtcgtaaa aaagttttat ctctttctct cttcgatggt ctcacaaaaa tattaaacct
177061 ctttctgatg gagtcgtaaa aaagttttat ctctttctcc ttcgatggtc tcacaaaaat
177121 attaaacctc tttctgatgg agtcgtaaaa aagttttatc tctttctctc ttcgatggtc
177181 tcacaaaaat attaaacctc tttctgatgg tgtcactaaa atatttttat tctctttctc
```

FIG. 22 (CONT.)

```
177241 tcttcgatgg tctcacaaaa atattaaacc tctttctgat ggagtcgtaa aaaagtttta
177301 tctctttctc cttcgatggt ctcacaaaaa tattaaacct ctttctgatg gagtcgtaaa
177361 aaagttttat ctctttctct cttcgatggt ctcacaaaaa tattaaacct ctttctgatg
177421 gagtcgtaaa aaagttttat ctctttctcc ttcgatggtc tcacaaaaat attaaacctc
177481 tttctgatgg agtcgtaaaa aagttttatc tctttctcct tcgatggtct cacaaaaata
177541 ttaaacctct ttctgatgga gtcgtaaaaa agttttatct ctttctcctt cgatggtctc
177601 acaaaaatat taaacctctt tctgatggag tcgtaaaaaa gttttatctc tttctctctt
177661 cgatggtctc acaaaaatat taaacctctt tctgatggag tcgtaaaaaa gttttatctc
177721 tttctctctt cgatggtctc acaaaaatat taaacctctt tctgatggag tcgtaaaaaa
177781 gttttatctc tttctccttc gatggtctca caaaaatatt aaacctcttt ctgatggtct
177841 ctataaagcg attgattttt cttaccctct agagtttcct acggtcgttg gtcacacatt
177901 tttttctaga cactaaataa ata
```

FIG. 23

VacciniavirusWR,completegenome(GenBankAccessionNo.:AY243312.1;SEQIDNO:2)

```
   1 atttaaaata taatattaat gtactaaaac ttatatatta ttaatttatc taactaaagt
  61 tagtaaatta tatatataat tttataatta atttaatttt actaatttta tttagtgtct
 121 agaaaaaaat gtgtgaccca tgactgtagg aaactctaga gtgtaagaaa gatcgatcgc
 181 tttatagaga ccatcagaaa gaggtttaat atttttgtga gaccatcgaa gagagaaaga
 241 gataaaactt ttttacgact ccatcagaaa gaggtttaat atttttgtga gaccatcgaa
 301 gagagaaaga gataaaactt ttttacgact ccatcagaaa gaggtttaat atttttgtga
 361 gaccatcgaa ggagaaagag ataaaacttt tttacgactc catcagaaag aggtttaata
 421 tttttgtgag accatcgaag gagaaagaga taaaactttt ttacgactcc atcagaaaga
 481 ggtttaatat ttttgtgaga ccatcgaaga gagaaagaga taaaactttt ttacgactcc
 541 atcagaaaga ggtttaatat ttttgtgaga ccatcgaaga gagaaagaga taaaactttt
 601 ttacgactcc atcagaaaga ggtttaatat ttttgtgaga ccatcgaagg agaaagagat
 661 aaaacttttt tacgactcca tcagaaagag gtttaatatt tttgtgagac catcgaagag
 721 agaaagagat aaaacttttt tacgactcca tcagaaagag gtttaatatt tttgtgagac
 781 catcgaagag agaaagagat aaaacttttt tacgactcca tcagaaagag gtttaatatt
 841 tttgtgagac catcgaagag agaaagagat aaaacttttt tacgactcca tcagaaagag
 901 gtttaatatt tttgtgagac catcgaagag agaaagagat aaaacttttt tacgactcca
 961 tcagaaagag gtttaatatt tttgtgagac catcgaagag agaaagagat aaaacttttt
1021 tacgactcca tcagaaagag gtttaatatt tttgtgagac catcgaagag agaaagagaa
```

FIG. 23 (CONT.)

```
1081 agagatagtt gatctagata tttttcttag tacaaaagtc aatgttttaa aatatatgga
1141 caagaatttg tctgtataaa aacttgtgtg aaattttgta ccaaagaaaa aatgtgagca
1201 gtatccccta catggatttt actagatcat ttatatacca aaaaatatta tacgatctac
1261 gttttattat atgattttaa cgtgtaaatt ataaacatta ttttatgata tacaattgtc
1321 tggtaaccta gatgggcata ggggatgttg ataagctcga cgagtatatg ttgttggacg
1381 ttattgttta agaaatagtt gatgcatcag aaagagaata aaaaatattt tagtgagacc
1441 atcgaagaga gaaagagata aaactttttt acgactccat cagaaagagg tttaatattt
1501 ttgtgagacc atcgaagaga gaaagagata aaactttttt acgactccat cagaaagagg
1561 tttaatattt ttgtgagacc atcgaagaga gaaagagata aaactttttt acgactccat
1621 cagaaagagg tttaatattt ttgtgagacc atcgaagaga gaaagagata aaactttttt
1681 acgactccat cagaaagagg tttaatattt ttgtgagacc atcgaagaga gaaagagata
1741 aaactttttt acgactccat cagaaagagg tttaatattt ttgtgagacc atcgaagaga
1801 gaaagagata aaactttttt acgactccat cagaaagagg tttaatattt ttgtgagacc
1861 atcgaagaga gaaagagata aaactttttt acgactccat cagaaagagg tttaatattt
1921 ttgtgagacc atcgaagaga gaaagagata aaactttttt acgactccat cagaaagagg
1981 tttaatattt ttgtgagacc atcgaagaga gaaagagata aaactttttt acgactccat
2041 cagaaagagg tttaatattt ttgtgagacc atcgaagaga gaaagagata aaactttttt
2101 acgactccat cagaaagagg tttaatattt ttgtgagacc atcgaagaga gaaagagata
2161 aaactttttt acgactccat cagaaagagg tttaatattt ttgtgagacc atcgaagaga
2221 gaaagagata aaactttttt acgactccat cagaaagagg tttaatattt ttgtgagacc
2281 atcgaagaga gaaagagata aaactttttt acgactccat cagaaagagg tttaatattt
```

FIG. 23 (CONT.)

```
2341 ttgtgagacc atcgaagaga gaaagagata aaactttttt acgactccat cagaaagagg
2401 tttaatattt ttgtgagacc atcgaagaga gaaagagata aaactttttt acgactccat
2461 cagaaagagg tttaatattt ttgtgagacc atcgaagaga gaaagagata aaactttttt
2521 acgactccat cagaaagagg tttaatattt ttgtgagacc atcgaagaga gaaagagata
2581 aaactttttt acgactccat cagaaagagg tttaatattt ttgtgagacc atcgaagaga
2641 gaaagagata aaactttttt acgactccat cagaaagagg tttaatattt ttgtgagacc
2701 atcgaagaga gaaagagaat aaaaatattt tatgactcca ttgaagagag aaagagaaaa
2761 tgagaatgag aataaaaata ttttagtgac accatcagaa agaggtttaa tatttttgtg
2821 agaccatcga agagagaaag agaataaaaa tattttatga ctccattgaa gagagaaaga
2881 gaaaatgaga atgagaataa aaatatttta gtgacaccat cagaaagagg tttaatattt
2941 tttatgagac catcaaagag agaaagagaa taaaaatatt tttgtaaaac tttttttatg
```

FIG. 23 (CONT.)

```
3001 agaccatcaa agagagaaag agaataaaaa tatttttgta aaactttttt tatgagacca
3061 tcaaagagag aaagagaata aaaatatttt tgtaaaactt tttttatgag accatcaaag
3121 agagaaagag aataaaaata tttttgtaaa acttttttta tgagaccatc aaagagagaa
3181 agagaataaa aatatttttg taaaactttt tttatgagac catcaaagag agaaagagaa
3241 taaaaatatt tttgtaaaac tttttttatg agaccatcaa agagagaaag agaataaaaa
3301 tatttttgta aaactttttt tatgagacca tcaaagagag aaagagaata aaaatatttt
3361 tgtaaaactt tttttatgag accatcagaa agaggtttaa tatttttgtg ataccctgaa
3421 aggaaatagg aataggaata ggaatagtgt cataatcgta tcacactatt gagacagaaa
3481 aagaagaagt cgcgagaggt aactttttgt gaatgtagtt aagaacattt ttgttttgca
3541 aaccggaata tagtgtccgg tacacttttt taattcgtgg tgtgcctgaa tcgttcgatt
3601 aaccctactc atccaatttc agatgaatag agttatcgat tcagacacac gctttgagtt
3661 ttgttgaatc gatgagtgaa gtatcatcgg ttgcaccttc agatgccgat ccgtcgacat
3721 acttaaatcc atccttgacc tcaagttcag atgattcctt gcacatgtct ccgatacgaa
3781 cgctaaactc tagattcttg acacattttg tatcgacgat cgttgaaccg atgatatctt
3841 cgtaactcac tttcttatga gagatgttag acccgagtac tggatgggtc ttgatgtcgc
3901 tgtctttctc ttcttcgcta catctgatgt cgatagacac ctcacagtct ttgatcatag
3961 ccagagcttc ttcatgagtg atcgcgggag agtccttacc ttgtcctggg gacacgctgg
4021 acaatctagc attcactgtg tttccatcag cggattctga gatggattta atctgaggac
4081 atttggtgaa tccaaagttc attctcagac ctccaccgat gatggagtaa taagtggtag
4141 gaggatctac atcctcgact gatgtggaat catcttctga ttccacctcg ggatctggat
```

FIG. 23 (CONT.)

```
4201 ctgactcgga ctctgtaatt tccgttacgg attggcaaat cttatcattg gtcggtgttt
4261 ggtcttgctt tgtgactttg ataataacat cgattcccat atgatgtttg ttttcttctt
4321 ccgtacacga ggaggaggat gaggatgatt gctgaagact ggcaggcaca tgcatgccag
4381 gacgatatat tgtttcatga ttgctattga ttgagtactg ttctttatga ttctacttcc
4441 ttaccgtgca ataaattaga atatattttc tacttttacg agaaattaat tattgtattt
4501 attatttatg ggtgaaaaac ttactataaa aagcgggtgg gtttggaatt agtgatcagt
4561 ttatgtatat cgcaactacc gggcatatgg ctatcgacat cgagaacatt acccacatga
4621 taagagattg tatcagtttc gtagtcttga gtattggtat tactatatag tatatagatg
4681 tcgacgctag atagacagtc tccgaatgcg gcatgatacc gtcatcattc tttgctttcg
4741 ttaactgttt ggaggaaaaa tttttgttat tgcatttaat ctcgaaattc agagtgcaca
4801 cctttctcct gtaaagaaac ctgaagttgc taccttatta aggacggaga agtattcctc
4861 acgaaatacg ggattacagt ctttatgatt catagtaata gttagttccg acgttgagat
4921 ggattcgctg agaccggtag tggtcgttaa ctggatacag attaatttcc acatcgatat
4981 agttaaaggt attactgggt acgggttcgc atttatctgc ggaagagacg gtgtgagaat
5041 atgttccgag accacacgga gaacagatga cgtctccgga tactccgtat cctattccac
5101 atttgtttgg ggaaacacat gccttgcatc cggatgatcc tttgagaaga caataatatc
5161 cgggagagca ttcacagatt ctattgtgag tcgtgttaca cggtcgcgtc ttccgttaca
5221 acttagacaa gcgggtaaat gattattgcg agatgtgaag gtacccgaac cacacggcgt
5281 acattgtgtg ttagtcttgc tatcgcataa tctggaagcg tatgttcccg gacacaaatt
5341 atggcgtttg tattcgttgt ctttacactt tccatcggat ggtgcatgcg gtgctatatc
```

FIG. 23 (CONT.)

```
5401 tcttccgttt attattatac atgagagaaa caatatatac gagtataata cggacttcat
5461 gatttaataa tgtagtaatc gtcgtcttgt tcctgtttcc tacttctcca atcatataga
5521 tattttcttt ctatcatgga taatatttgt aatggttctt ttcgtacaac atactgttta
5581 gatgatattg cgcataattt ccggaggcaa atacgatagt ctagattgac cgatggtaga
5641 ctctaattta ttgagtgctt tgtcgacgag tttactttta cgctccatcg atagatggca
5701 ctgttctatg agatcgtcgt acatgggaaa tgaaatgtga ctgtctgaat gtatggcttt
5761 aagatagctg tgataccgta tacaggtcgg tgtcggagat tcgaatctct ttaaggcgac
5821 ttatgtcacg atgatggaat ctatcttatc gaatgatata tttttcataa atacactttt
5881 atagtcctcg tttaaacaga atttactatg tagttccgcg aatgactcgt cccttaatag
5941 gcagtaggct attatcttct ttacgtagta atcgtcgtag ggagagacat cttgtagaac
6001 aacgatttaa tcataggtag agatactttc agtctgtggt ggatgatgtc attcacaaca
6061 tccgccttgt atatgatgtt tctgttttca aacaccaagt cgaataccgt ctttagtcgg
6121 aaggttgatg tcgtatccga tgtatgaggc aacattgttg ttacaatttt gaaaggcggt
6181 attatagtat tcgtctttct gaatgtcgaa cctatctagt agataccgta gtatattgag
6241 agtgtatcct tgattatgtt ttatgaatag ataaagtaga tgttgtcctt cttccttttg
6301 ttcgtgccaa ttgagtaaca ttatgagaat atgacctgtt gcacaatcgt tccatgatgg
6361 gtgtacaatc aagattatta cgtatcctcg tatcggctcc tcgagataaa agagcataca
6421 ccacacgagg actatgtttg gtatactgtt gaaggtaagt gtgtaaccgc gttaatgttt
6481 gctccataat ctattatcgc gtagatgaat cgcttctcgg ctcgcatctt agtgtgactt
6541 aacttgtaat aattgctttt gtagaacgtg gatatgtgtt tacagtagta atgaagagaa
```

FIG. 23 (CONT.)

```
6601 gtgagttcat cctcgtcgga tcctttgtac agaacgtaat agtttaagct cccattgaat
6661 ttatatctaa gataacacag caatagatcg gatgatttac taaagtcatc aatggtgtcc
6721 gttagtatat caaagatctt gttatcgatt gatagtggtg tcctttttca tccttgctat
6781 caaagttacg catgccgtgg tgtaacaata tctttaatac agatggatta aatcgtgtat
6841 tcatcgtata gcaatgtaat ggagagttac ctcgtttatt cagatcgcag tgtttaataa
6901 ctagcttaaa cagatgagac gatgtatcca catcaaagaa cgtgaaatac atatgacaga
6961 cattgttgac agaaacgtga ccttcattct taccgtcgtc cataaatacg ttaggtatgt
7021 accacatact gtcgcgaacg atgcgtacaa tctcgtccat ctcataatga tttacttttt
7081 cataattaaa gatgtgaaag aaaaacagaa caatatattt ttttagtaat gtttatgcga
7141 gacatataaa ataaactccg tgtttatgat catttttaac agcaacacat tcaatattgt
7201 attgttattt ttatattatt tacacaatta acaatatatt attagtttat attactgaat
7261 taataatata aaattcccaa tcttgtcata aacacacact gagaaacagc ataaacacaa
7321 aatccatcaa aaatgtcgat gaaatatctg atgttgttgt tcgctgctat gataatcaga
7381 tcattcgccg atagtggtaa cgctatcgaa acgacatcgc cagaaattac aaacgctaca
7441 acagatattc cagctatcag attatgcggt ccagagggag atggatattg tttacacggt
7501 gactgtatcc acgctagaga tattgacggt atgtattgta gatgctctca tggttataca
7561 ggcattagat gtcagcatgt agtattagta gactatcaac gttcagaaaa cccaaacact
7621 acaacgtcat atatcccatc tcccggtatt atgcttgtat tagtaggcat tattattatt
7681 acgtgttgtc tattatctgt ttataggttc actcgacgaa ctaaactacc tatacaagat
7741 atggttgtgc cataattttt ataaattttt ttatgagtat ttttacaaaa aaaatgtata
```

FIG. 23 (CONT.)

```
7801 aagtgtatgt cttatgtata tttataaaaa tgctaagtat gcgatgtatc tatgttattt
7861 gtatttatct aaacaatacc tctacctcta gatattatac aaaaattttt tatttcggca
7921 tattaaagta aaatctagtt accttgaaaa tgaatacagt gggtggttcc gtatcaccag
7981 taagaacata atagtcgaat acagtatccg attgagattt tgcatacaat actagtctag
8041 aaagaaattt gtaatcatct tctgtgacgg gagtccatat atctgtatca tcgtctagtt
8101 tatcagtgtc ccatgctata ttcctgttat catcattagt taatgaaaat aactctcgtg
8161 cttcagaaaa gtcaaatatt gtatccatac atacatctcc aaaactatcg cttatacgtt
8221 tatctttaac gatacctata cctagatggt tatttactaa cagacatttt ccagatctat
8281 tgactataac tcctatagtt tccacatcaa ccaagtaatg atcatctatt gttatataac
8341 aataacataa ctcttttcca tttttatcag tatgtatatc tatatcaacg tcgtcgttgt
8401 agtgaatagt agtcattgat ctattatatg aaacggatat gtctagaacg gcaattgttt
8461 tacgtccagt taacactttc tttgatttaa agtctagagt ctttgcaaac ataatatcct
8521 tatccgactt tatatttcct gtagggtggt ataattttat tttgcctcca catatcggtg
8581 tttccaaata tattactaga caatattcca tatagttatt agttaagggt acccaattag
8641 aacacgtacg cttattatca tcatttggat cgtatttcat aaaagttatt gtactatcga
8701 tgtcaacaca ttctacattt tttaatcgtc tatatagtat ttttctgata ttttctataa
8761 tatcagaatt gtcttccatc ggaagttgta tactatcgga atcagttaca tgtttaaata
8821 attctctgat gtcattcctt atacaatcaa attcattatt aaacagttta atagtctgta
8881 gacctttatc gtcgtaaata tccattgtct tattagttac gcttattttt atgtgtttta
8941 cgttgcttta ttatatttta taagaatgat tgtttgacga atcacgagaa ctattaagac
9001 acattattag gtatatatta taaaaaagtt tttgattacg atgttataag aggaaagagg
```

FIG. 23 (CONT.)

```
9061 acacattaac atcatacatc aattaactac attcttataa catcgtaatc aaaagaattg
9121 caattttgat gtataacaac tgtcaatggg ttatggaatt gtatattaca tattatacgg
9181 tatgttggta acgacaaata ccgatcggta attgtctgcc ggtgtaatag aattatatat
9241 atctatctat tacaccggct gagtatgcat aataataagt tgtggtagta tgatctccat
9301 atttataatt taggactttg tattcagtat ttttggaatc ataaaaaata aaaaaaagtt
9361 ttactaattt aaaatttaaa aagtatttac atttttttca ctgtttagtc gcggatatgg
9421 aattcgatcc tgccaaaatc aatacatcat ctatagatca tgtaacaata ttacaataca
9481 tagatgaacc aaatgatata agactaacag tatgcattat ccgaaatatt aataacatta
9541 catattatat caatatcaca aaaataaata cacatttggc taatcaattt cgggcttgga
9601 aaaaacgtat cgccggaagg gactatatga ctaacttatc tagagataca ggaatacaac
9661 aatcaaaact tactgaaact atacgtaact gtcaaaaaaa tagaaacata tatggtctat
9721 atatacacta caatttagtt attaatgtgg ttattgattg gataaccgat gtgattgttc
9781 aatcaatatt aagagggttg gtaaattggt acatagctaa taatacctat acacccaata
9841 atacaacaac catttctgag ttggatatca tcaaaatact ggataaatac gaggacgtgt
9901 atagagtaag taaagaaaaa gaatgtggaa tttgctatga agttgtttac tcaaaacgat
9961 agatactttg gtttattgga ttcgtgtact catatatttt gcataacatg catcaatata
10021 tggcataaaa cacgaagaga aaccggtgcg tcggataatt gtcctatatg tcgtacccgt
10081 tttagaaaca taacaatgag caagttctat aagctagtta actaataaat aaaaagttta
10141 atttgttgac gacgtatgtc gttatttttc tcgtatgaaa gattaaattc aattcaattc
10201 gttgtttcta atataatctg ccgtattgga tggattctca agacaattgc atttagatta
```

FIG. 23 (CONT.)

```
10261 tattatcatg aataaaaata gtagcacgca ctacttcagc caaatattct tttttgaaac
10321 gccatctatc gtagtgagga cacaagtgaa cctataatta tcaaatttat tagtatcagt
10381 cacatgaagg actttctgta gagtgacgat tctaccatct atggtactaa cggtttcatc
10441 ctccttgata ccctcaccca aatgttctat aaatttagca tcctcgtccg atctcatatc
10501 ctttgccaac caatacatgt agctaaaatt aggcataaat ttcacacatc cagtgcaacg
10561 aaattctcca gaagatgtta cgatgtttag gttaggacat ttgatttcgt cggcattaac
10621 atatgggtga acacacccat acatgaaagc gatgagaaat aggattctca tcttgccaaa
10681 atatcactag aaaaaattta tttatcaatt ttaaaggtat aaaaaatact tattgttgct
10741 cgaatatttt gtatttgatg gtatacggaa gattagaaat gtaggtatta tcatcaactg
10801 attctatggt tttatgtatt ctatcatgtt tcactattgc gtcggaaata atatcatatg
10861 cttccacata tattttattt tgttttaact cataatactc acgtaattct ggattattgg
10921 catatctatg aataatttta gctccatgat cagtaaatat taatgagaac atagtattac
10981 cacctaccat tatttttttc atttcgttca attcttgatt gcaaagatct atataatcat
11041 tatagcgttg acttatggac tctggaatct tagacgatgt acagtcatct ataatcatgg
11101 catatttaat acattgtttt atagcatagt agttatctac gatgttagat atttctctca
11161 atgaatcaat cacacaatct aatgtaggtt tatgacataa tagcattttc agcagttcaa
11221 tgtttctaga ttcgttgatg gcaatggcta tacatgtata tccgttattt gatctaatgt
11281 tgacatctga accggattct agcagtaaag atactagaga ttgtttatta tatctaacag
11341 ccttgtgaag aagtgtttct cctcgtttgt caatcatgtt aatgtcttta agataaggta
11401 ggcaaatgtt tatagtacta agaattgggc aagcataaga catgtcacaa agaccctttt
```

FIG. 23 (CONT.)

```
11461 tgtatgtata agtgtaaaaa ttataacatt catagttgga tttacatagg tgtccaatcg
11521 ggatctctcc atcatcgaga taattgatgg catctccctt cctttttag tagatatttc
11581 atcgtgtaag aatcaatatt aatatttcta aagtattcgt gtatagcctc tttatttacc
11641 acagttccat attccactag agggatatcg ccgaatgtca tatactcaat tagtatatgt
11701 tggaggacat ccgagttcat tgttttcaat atcaaaaaga tggtttcctt atcatttctc
11761 catagtggta caatactaca cattattccg tgcggctttc cattttccaa aaacaatttg
11821 accaaatcta aatctacatc tttattgtat ctataatcac tatttagata atcagccata
11881 attactcgag tgcaacatgt tagatcgtct atatatgaat aagcagtgtt atctattcct
11941 ttcattaaca atttaacgat gtctatatct atatgagatg acttaatata atattgaaga
12001 gctgtacaat agtttttatc tatagaagac ggcttgattc cgtgattaat tagacattta
12061 acaacttccg gacgcacata tgctctcgta tccgactttg aatacagatg agagatgata
12121 tacagatgca atacggtacc gcaatttcgt agttgataat catcatacgc gtatcagtac
12181 tcgtcctcat aaagaacact gcagccattt tctatgaaca aatcaataat tttaggaaca
12241 ggatcattgt cattacataa ttttctataa ctgaacgatg gttttcacat ttaacactca
12301 agtcaaatcc atgttctacc aacaccttta tcaagtcaac gtctacattt ttggatttca
12361 tatagctgaa tatattaaag tcatttatgt tgctaaatcc agtggcttct agtagagcca
12421 tcgctatatc ctttaacttt aacatgtcta ctatttgtgt attcttctaa tggggtagct
12481 gtctccaatt tttgcgtaat ggattagtgc cactgtctag tagtagtttg acgacctcga
12541 cattattaca atgctcatta aaaaggtatg cgtgtaaagc attattcttg aattggttcc
12601 tggtatcatt aggatctctg tctctcaaca tctgtttaag ttcatcgaga gccacctcct
12661 cattttccag atagtcaaac atttgactg aatgagctac tgtgaactct atacacccac
```

FIG. 23 (CONT.)

```
12721 acaactaatg tcattaaata ttattttttt gaatgtattt ataccatgtc aaaaacttgt
12781 acaattatta ataaaaataa tttagtgttt aaattttacc agttccagat tttacacctc
12841 cgttaacccc actttttaca ccactggacg atcctcctcc ccacattcca ccgccaccag
12901 atgtataagt tttagatcct ttattactac catcatgtcc atggataaag acactccaca
12961 tgccgccact actacccct ttagaagaca tattaataag acttaaggac aagtttaaca
13021 ataaaattaa tcacgagtac cctactacca acctacacta ttatatgatt atagtttcta
13081 tttttacagt accttaacta aagtctctag tcacaagagc aatactacca acctacacta
13141 ttatatgatt atagtttcta tttttatagg aacgcgtacg agaaaatcaa atgtctaatt
13201 tctaacggta gtgttgataa acgattatcg tcaatggata cctcctctat catgtcgtct
13261 attttcttac tttgttctat taacttatta gcattatata ttatttgatt ataaaactta
13321 tattgcttat tagcccaatc tgtaaatatc ggattattaa catatcgttt ctttgtaggt
13381 ttatttaaca tgtacatcac tgtaagcatg tccgtaccat ttattttaat ttgacgcata
13441 tccgcaattt ctttttcgca gtcggttata aattctatat atgatggata catgctacat
13501 gtgtacttat aatcgactaa tatgaagtac ttgatacata ttttcagtaa cgatttatta
13561 ttaccaccta tgaataagta cctgtgatcg tctaggtaat caactgtttt cttaatacat
13621 tcgatggttg gtaatttact cagaataatt tccaatatct taatatataa ttctgctatt
13681 tctgggatat atttatctgc cagtataaca caaatagtaa tacatgtaaa cccatatttt
13741 gttattatat taatgtctgc gccattatct attaaccatt ctactaggct gacactatgc
13801 gacttaatac aatgataaag tatactacat ccatgtttat ctattttgtt tatatcatca
13861 atatacggct tacaaagttt tagtatcgat aacacatcca actcacgcat agagaaggta
```

FIG. 23 (CONT.)

13921 gggaataatg gcataatatt tattaggtta tcatcattgt cattatctac aactaagttt
13981 ccatttttta aaatatactc gacaacttta ggatctctat tgccaaattt ttgaaaatat
14041 ttatttatat gcttaaatct atataatgta gctccttcat caatcataca tttaataaca
14101 ttgatgtata ctgtatgata agatacatat tctaacaata gatcttgtat agaatctgta
14161 tatcttttaa gaattgtgga tattaggata ttattacgta aactattaca caattctaaa
14221 atataaaacg tatcacggtc gaataatagt tgatcaacta tataattatc gattttgtga
14281 tttttcttcc taaactgttt acgtaaatag ttagatagaa tattcattag ttcatgacca
14341 ctatagttac tatcgaataa cgcgtcaaat atttcccgtt taatatcgca tttgtcaaga
14401 taataataga gtgtggtatg ttcacgataa gtataataac gcatctcttt tttgtgtgaa
14461 attaaatagt ttatcacgtc caaagatgta gcataaccat cttgtgacct agtaataata
14521 taataataga gaactgtttt acccattcta tcatcataat cagtggtgta gtcgtaatcg
14581 taatcgtcta attcatcatc ccaattataa tattcaccag cacgtctaat ctgttctatt
14641 ttgatcttgt atccatactg tatgttgcta catgtaggta ttcctttatc caataatagt
14701 ttaaacacat ctacattggg atttgatgtt gtagcgtatt tctctacaat attaatacca
14761 tttttgatac tatttatttc tatacctttc gaaattagta atttcaataa gtctatatcg
14821 atgttatcag aacatagata ttcgaatata tcaaaatcat tgatattttt atagtcgact
14881 gacgacaata acaaaatcac aacatcgttt ttgatattat tatttttctt ggtaacgtat
14941 gcctttaatg gagtttcacc atcatactca tataatggat ttgcaccact ttctatcaat
15001 gattgtgcac tgctggcatc gatgttaaat gttttacaac tatcatagag tatcttatcg
15061 ttaaccatga ttggttgttg atgctatcgc atttttggt ttctttcatt tcagttatgt

FIG. 23 (CONT.)

15121 atggatttag cacgtttggg aagcatgagc tcatatgatt tcagtactgt agtgtcagta
15181 ctattagttt cgatcagatc aatgtctaga tctatagaat caaaacacga taggtcagaa
15241 gataatgaat atctgtacgc ttctttttgt actgtaactt ctggttttgt tagatggttg
15301 catcgtgctt taacatcaat ggtacaaatt ttatcctcgc tttgtgtatc atattcgtct
15361 ctagtataaa attctatatt cagattatca tgcgatgtgt atacgctaac ggtatcaata
15421 aacggagcac accatttagt cataacagta atccaaaatt ttttaaagta tatcttaacg
15481 aaagaagttg tgtcattgtc tacggtgtat ggtactagat cctcataagt gtatatatct
15541 agagtaatgt ttaatttatt aaatggttga taatatggat cctcatgaca atttccgaag
15601 atggaaatga gatatagaca tgcaataaat ctaatcgaag acatggttac tccttaaaaa
15661 aatacgaata atcaccttgg ctatttagta agtgtcattt aacactatac tcatattaat
15721 ccatggactc ataatctcta tacgggatta acggatgttc tatatacggg gatgagtagt
15781 tttcttcttt aactttatac tttttactaa tcatatttag actgatgtat gggtaatagt
15841 gtttaaagag ttcgttctca tcatcagaat aaatcaatat ctctgttttt ttgttataca
15901 gatgtattac agcctcatat attacgtaat agaacgtgtc atctacctta ttaactttca
15961 ccgcatagtt gtttgcaaat acggttaatc ctttgacctc gtcgatttcc gaccaatctg
16021 ggcgtataat gaatctaaac tttaatttct tgtaatcatt cgaaataatt tttagtttgc
16081 atccgtagtt atcccettta tgtaactgta aatttctcaa cgcgatatct ccattaataa
16141 tgatgtcgaa ttcgtgctgt atacccatac tgaatggatg aactaacgaa tatcaacggc
16201 gttaatagta atttactttt tcatctttac atattgggta ctagttttac tatcataagt
16261 ttataaattc cacaagctac tatggaataa gccaaccatc ttagtatacc acacatgtct
16321 taaagtttat taattaatta catgttgttt tatatatatc gctacgaatt taaagagaaa

FIG. 23 (CONT.)

16381 tcagtttagg aagaaaaaaa ttatctatct acatcatcac gtctctgtat tctacgatag
16441 agtgctactt taagatgaga catatccgtg tcatcaaaaa tatactccat taaaatgatt
16501 attccggcag cgaacttgat attggatata tcacaacctt tgttaatatc tacgacaata
16561 gacagcagtc ccatggttcc ataaacagtg agtttatctt tctttgaagc gatagtttgt
16621 agagatctta taaaaccgtc aaacgacatc gcatttatat ctttagctaa ttcatatatg
16681 ttaccatcgt aatatctaac cgcgtctatc ttaaacgttt ccatcgcttt aaagacgttt
16741 ccgatagatg gtctcatttc atcagtcata ctgagccaac aaatataatc gtgtataaca
16801 tctttgatag aatcagactc taaagaaaac gaatcggctt tattatacgc attcatgata
16861 aacttaatga aaaatgtttt tcgttgttta agttggatga atagtatgtc ttaataattg
16921 ttattatttc attaattaat atttagtaac gagtacactc tataaaaacg agaatgacat
16981 aactagttat caaagtgtct aggacgcgta attttcatat ggtatagatc ctgtaagcat
17041 tgtctgtatt ctggagctat tttctttatc gcattagtaa gttcagaata tgttataaat
17101 ttaaatcgaa taacgaacat gactttagta aagtcgtcta tattaactct tttattttct
17161 agccatcgta ataccatgtt taagatagta tattctctag ttactacgat ctcatcgttg
17221 tctagaatat cacatactga atctacatcc aattttagaa attggtctgt gttacatatc
17281 tcttctatat tattgttgat gtattgtcgt agaaaactat tacgtagacc attttcttta
17341 taaaacgaat atatagtact ccaattatct ttaccgatat atttgcacac ataatccatt
17401 ctctcaatca ctacatcttt aagattttcg ttgttaagat atttggctaa actatataat
17461 tctattagat catcaacaga atcagtatat atttttctag atccaaagac gaactctttg
17521 gcgtcctcta taatattccc agaaaagata ttttcgtgtt ttagtttatc gagatctgat

FIG. 23 (CONT.)

17581 ctgttcatat acgccatgat tgtacggtac gttatgataa ccgcataaaa taaaaatcca
17641 ttttcatttt taaccaatac tattcataat tgagattgat gtaatacttt gttactttga
17701 acgtaaagac agtacacgga tccgtatctc caacaagcac gtagtaatca aatttggtgt
17761 tgttaaactt cgcaatattc atcaatttag atagaaactt atactcatca tctgttttag
17821 gaatccatgt attattacca ctttccaact tatcattatc ccaggctatg tttcgtccat
17881 catcgttgcg cagagtgaat aattcttttg tattcggtag ttcaaatata tgatccatgc
17941 atagatcggc aaagctattg tagatgtgat ttttcctaaa tctaatataa aactcgttta
18001 ctagcaaaca ctttcctgat ttatcgacca agacacatat ggtttctaaa tctatcaagt
18061 ggtggggatc catagttatg acgcagtaac atagattatt acattcttga ctgtcgctaa
18121 tatctaaata tttattgtta tcgtattgga ttctgcatat agatggcttg tatgtcaaag
18181 atatagaaca cataaccaat ttatagtcgc gctttacatt ctcgaatcta aagttaagag
18241 atttagaaaa cattatatcc tcggatgatg ttatcactgt ttctggagta ggatatatta
18301 aagtctttac agatttcgtc cgattcaaat aaatcactaa ataatatccc acattatcat
18361 ctgttagagt agtatcatta aatctattat attttatgaa agatatatca ctgctcacct
18421 ctatatttcg tacattttta aactgtttgt ataatatctc tctgatacaa tcagatatat
18481 ctattgtgtc ggtagacgat accgttacat ttgaattaat ggtgttccat tttacaactt
18541 ttaacaagtt gaccaattca tttctaatag tatcaaactc tccatgatta aatattttaa
18601 tagtatccat tttatatcac tacggacaca aagtagctga cataaaccat tgtataattt
18661 ttatgtttta tgtttattag cgtacacatt ttggaagttc cggcttccat gtatttcctg
18721 gagagcaagt agatgatgag gaaccagata gtttatatcc gtacttgcac ttaaagtcta

FIG. 23 (CONT.)

```
18781 cattgtcgtt gtatgagtat gatcttttaa acccgctaga caagtatccg tttgatattg
18841 taggatgtgg acatttaaca atctgacacg tgggtggatc ggaccattct cctcctgaac
18901 acaggacacc agagttacca atcaacgaat atccactatt gcaactataa gttacaacgc
18961 tcccatcggt ataaaaatcc tcgtatccgt tatgtcttcc gttggatata gatggagggg
19021 attggcattt aacagattca caaataggtg cctcgggatt ccataccata gatccagtag
19081 atcctaattc acaatacgat ttagattcac cgatcaaatg atatccgcta ttacaagagt
19141 acgttatact agagccaaag tctactccac caatatcaag ttggccatta tcgatatctc
19201 gaggcgatgg gcatctccgt ttaatacatt gattaaagag tgtccatcca gtacctgtac
19261 atttagcata tataggtccc atttttgct ttctgtatcc aggtagacat agatattcta
19321 tagtgtctcc tatgttgtaa ttagcattag catcagtctc cacactattc ttaaatttca
19381 tattaatggg tcgtgacgga atagtacagc atgatagaac gcatcctatt cccaacaatg
19441 tcaggaacgt cacgctctcc accttcatat ttatttatcc gtaaaaatgt tatcctggac
19501 atcgtacaaa taataaaaag cccatatatg ttcgctattg tagaaattgt ttttcacagt
19561 tgctcaaaaa cgatggcagt gacttatgag ttacgttaca ctttggagtc tcatctttag
19621 taaacatatc ataatattcg atattacgag ttgacatatc gaacaaattc caagtatttg
19681 attttggata atattcgtat tttgcatctg ctataattaa gatataatca ccgcaagaac
19741 acacgaacat ctttcctaca tggttaaagt acatgtataa ttctatccat ttgtcttcct
19801 taactatata tttgtataga taattacgag tctcgtgagt aattccagta attacataga
19861 tgtcgccgtc gtactctaca gcataaacta tactatgatg tctaggcatg ggagactttt
19921 ttatccaacg atttttagtg aaacattcca catcgtttaa tactacatat ttttcatacg
19981 tggtataaac tccacccatt acatatatat catcgtttac gaataccgac gcgcctgaat
```

FIG. 23 (CONT.)

```
20041 atctaggagt aattaagttt ggaagtctta tccatttcga agtgccgtgt ttcaaatatt
20101 ctgccacacc cgttgaaata gaaaattcta atcctcctat tacatataac tttccatcgt
20161 taacacaagt actaacttct gattttaacg acgacatatt agtaaccgtt ttccattttt
20221 tcgtttcaag atctacccgc gatacggaat aaacatgtct attgttaatc atgccgccaa
20281 taatgtatag acaattatgt aaaacatttg cattatagaa ttgtctatct gtattaccga
20341 ctatcgtcca atattctgtt ctaggagagt aatgggttat tgtggatata taatcagagt
20401 ttttaatgac tactatatta tgttttatac catttcgtgt cactggcttt gtagatttgg
20461 atatagttaa tcccaacaat gatatagcat tgcgcatagt attagtcata aacttgggat
20521 gtaaaatgtt gatgatatct acatcgtttg gatttttatg tatccacttt aataatatca
20581 tagctgtaac atcctcatga tttacgttaa cgttttcgtg ggataagata gttgtcagtt
20641 catcctttga taattttcca aattctggat cggatgtcac cgcagtaata ttgttgatta
20701 tttctgacat cgacgcatta tatagttttt taattccata tcttttagaa aagttaaaca
20761 tccttataca atttgtggaa ttaatattat gaatcatagt ttttacacat agatctacta
20821 caggcggaac atcaattatt atggcagcaa ctagtatcat ttctacattg tttatggtga
20881 tgtttatctt cttccagcgt atatagtcta atagcgattc aaacgcgtga tagtttatac
20941 cattcaatat aatcgcttca tcctttagat ggtgatcctg aattcgttta aaaaaattat
21001 acggagatgc cgtaataatt tccttattca cttgtataat ttccccattg atagaaaata
21061 tcacgctttc cattcttgaa gtactataag taattatagt ataatgtaaa ggtttatata
21121 ttcaatattt tttataaaaa aatcattttg acattaattc ctttttaaat ttccgtctat
21181 catctataga aacgtattct atgaatttat aaaatgcttt tacgtgtcct atcgtaggcg
```

FIG. 23 (CONT.)

```
21241 atagaaccgc taaaaagcct atcgaatttc tacaaaagaa tctgttatat ggtataggga
21301 gagtataaaa cattaaatgt ccgtacttat taaagtattc agtagccaat cctaactctt
21361 tcgaatactt attaatggct cttgttctgt acgaatctat ttttttgaac aacggaccta
21421 gtggtatatc ttgttctatg tatctaaaat aatgtctgac tagatccgtt agtttaatat
21481 cctcagtcat cttgtctaga atggcaaatc taactgcggg tttaggcttt agtttagttt
21541 ttatatctac atctatgtct ttatctaaca ccaaaaatat aatagctaat attttattac
21601 aatcatccgg atattcttct acgatctcac taactaatgt ttctttggtt atactagtat
21661 agtcactatc ggacaaataa agaaaatcag atgatcgatg aataatacat ttaaattcat
21721 catctgtaag atttttgaga tgtctcatta aaatattatt agggtcagta ctcattatca
21781 ttcggcagct attacttatt ttatttttct gtattttatt atttttcacc atatagatca
21841 atcattagat catcaaaata tgtttcaatc atcctaaaga gtatggtgaa tgactcttcc
21901 catctaattt ctgaacgttc accaatgtct ctagccactt tggcactaat agcgatcatt
21961 cgcttagcgt cttctatatt attaactggt tgattcaatc tatctagcaa tggaccgtcg
22021 gacagcgtca ttctcatgtt cttaatcaat gtacatacat cgccgtcatc taccaattca
22081 tccaacaaca taagcttttt aaaatcatca ttataatagg tttgatcgtt gtcatttctc
22141 caaagaatat atctaataag tagagtcctc atgcttagta atttaactat tttagttaac
22201 aactattttt tatgttaaat caattagtac accgctatgt ttaatactta ttcatatttt
22261 agtttttagg attgagaatc aatacaaaaa attaatgcat cattaatttt agaaatactt
22321 agtttccacg tagttaatga aacatttgaa ctcatcgtac aggacgttct cgtacaggac
22381 gtaactataa accggtttat atttgttcaa gatagataca aatccgataa ctttttttac
```

FIG. 23 (CONT.)

```
22441 gaattctacg ggatccactt taaaagtgtc ataccgggtt ctttttattc ttttaaacag
22501 atcaatggtg tgatgttgat taggtctttt acgaatttga tatagaatag cgttcacata
22561 tcctccataa tggtcaatcg ccatttgttc gtatgtcata aattctttaa ttatatgaca
22621 ctgtgtatta tttagttcat ccttgttcat cattaggaat ctatccaaaa tggcaattat
22681 actagaacta taggtgcgtt gtatacacat attgatgtgt ctgtttatac aatccatgat
22741 atttggatcc atgctactac cttcgggtaa aattgtagca tcatatacca tttctagtac
22801 tttaggttca ttattatcca ttgcagagga cgtcatgatc gaatcctaaa aaaatatatt
22861 atttttatgt tattttgtta aaaataatca tcgaatactt cgtaagatac tccttcatga
22921 acataatcag ttacaaaacg tttatatgaa gtaaagtatc tacgattttt acaaaagtcc
22981 ggatgcataa gtacaaagta cgcgataaac ggaataataa tagatttatc tagtctatct
23041 ttttctatag ctttcatagt tagatacatg gtctcagaag taggattatg taacatcagc
23101 ttcgataaaa tgactgggtt atttagtctt acacattcgc tcatacatgt atgaccgtta
23161 actacaaagt ctacactaaa atgattgaac aatagatagt ctaccattgt ttcgtattca
23221 gatagtacag cgtagtacat agcatcttca caaattatat cattgtctaa tagatatttg
23281 acgcatctta tggatcccac ttcaacagcc atcttaaaat cggtagaatc atattgcttt
23341 cctttatcat taataatttc taaaacatca tctctatcat aaaagataca aatattaact
23401 gtttgatccg taataacatt gctagtcgat agcaatttgt taataagatg cgctgggctc
23461 aatgtcttaa taagaagtgt aagaggacta tctccgaatt tgttttgttt attaacatcc
23521 gttgatggaa gtaaaagatc tataatgtct acattcttga ctgttttaga gcatacaata
23581 tggagaggtg tatttccatc atgatctggt tttgagggac taattcctag tttcatcatc
23641 catgagattg tagaagcttt tggattgtct gacataagat gtctatgaat atgattttg
```

FIG. 23 (CONT.)

```
23701 ccaaatttat ccactatcct ggcttcgaat ccgatggaca ttattttttt aaacactctt
23761 tctgaaggat ctgtacacgc caacaacgga ccacatcctt cttcatcaac cgagttgtta
23821 atcttggctc catactgtac caataaattt attctctcta tgacttcatc atctgttccc
23881 gagagataat atagaggtgt tttattatgt ttatcacacg cgtttggatc tgcgccgtgc
23941 gtcagcagca tcgcgactat tctattatta ttaattttag aagctatatg caatggataa
24001 tttccatcat catccgtctc atttggagag tatcctctat gaagaagttc ttcgacaaat
24061 cgttcatcta gtcctttaat tccacaatac gcatgtagaa tgtgataatt atttccagaa
24121 ggttcgatag cttgtagcat attcctaaat acatctaaat ttttactatt atatttggca
24181 taaagagata gataatactc ggccgacata atgttgtcca ttgtagtata aaaattaata
24241 tttctatttc tatttctgta tatttgcaac aatttactct ctataacaaa tatcataact
24301 tagttctttt atgtcaagaa ggcactggtt tagttcatct ataaatgtca cgccataact
24361 accacgcatg ctatactcag aattatgata aagatattta tccttggggt gtaggtaatg
24421 gggattaatc tttgttggat cagtctctaa gttaacacat gtcacacatg atccatttat
24481 agttatatca cacgatgatg atttatgaat tgattccgga agatcgctat cgtattttgt
24541 ggttccacaa ttcatttcca tacatgttat tgtcacacta atattatgat gaactttatc
24601 tagccgctga gtggtaaaca acagaacaga tagtttatta tctttaccaa caccctcagc
24661 cgctgccaca aatctctgat ccgtatccat gatggtcatg tttatttcta gtccgtatcc
24721 agtcaacact atgttagcat ttctgtcgat atagctttca ctcatatgac actcaccaat
24781 aatagtagaa ttaatgtcgt aatttacacc aatagtgagt tcggcggcaa agtaccaata
24841 ccggtaatct tgtcgaggag gacatatagt attcttgtat tctaccgaat acccgagaga
```

FIG. 23 (CONT.)

```
24901 tgcgatacaa aagagtaaga ctaatttgta aaccatctta ctcaaaatat gtaacaatag
24961 tacgatgcaa tgagtaagac aataggaaat ctatcttata tacacataat tattctatca
25021 attttaccaa ttagttagtg taatgttaac aaaaatgtgg gagaatctaa ttagtttttc
25081 tttacacaat tgacgtacat gagtctgagt tccttgtttt tgctaattat ttcatccaat
25141 ttattattct tgactatatc gagatctttt gtataggagt cagacttgta ttcaacatgc
25201 ttttctataa tcattttagc tatttcggca tcatccaata gtacattttc cagattagca
25261 gaatagatat taatgtcgta tttgaacaga gcctgtaaca tctcaatgtc tttattatct
25321 atagccaatt taatgtccgg aatgaagaga agggaattat tggtgtttgt cgacgtcata
25381 tagtcgagca agagaatcat catatccacg tgtccatttt ttatagtgat gtgaatacaa
25441 ctaaggagaa tagccagatc aaaagtagat ggtatctctg aaagaaagta ggaaacaata
25501 cttacatcat taagcatgac ggcatgataa aatgaagttt tccatccagt tttcccatag
25561 aacatcagtc tccaattttt cttaacaaac agttttaccg tttgcatgtt accactatca
25621 accgcataat acaatgcggt gtttcccttg tcatcaaatt gtgaatcatc cagtccactg
25681 aatagcaaaa tctttactat tttggtatct tccaatgtgg ctgcctgatg taatggaaat
25741 tcattctcta gaagattttt caatgctcca gcgttcaaca acgtacatac tagacgcacg
25801 ttattatcag ctattgcata atacaaggca ctatgtccat ggacatccgc cttaaatgca
25861 tctttgctag agagaaagct tttcagctgc ttagacttcc aagtattaat tcgtgacaga
25921 tccatgtctg aaacgagacg ctaattagtg tatatttttt cattttttat aattttgtca
25981 tattgcacca gaattaataa tatctctaat agatctgatt agtagataca tggctatcgc
26041 aaaacaacat atacacattt aataaaaata atatttatta agaaaattca gatttcacgt
```

FIG. 23 (CONT.)

26101 acccatcaat ataaataaaa taatgattcc ttacaccgta cccatattaa ggagattcca
26161 ccttacccat aaacaatata aatccagtaa tatcatgtct gatgatgaac acaaatggtg
26221 tattaaattc cagtttttca ggagatgatc tcgccgtagc taccataata gtagatgcct
26281 ctgctacagt tccttgttcg tcgacatcta tctttgcatt ctgaaacatt ttataaatat
26341 ataatgggtc cctagtcata tgtttaaacg acgcattatc tggattaaac atactaggag
26401 ccatcatttc ggctatcgac ttaatatccc tcttattttc gatagaaaat ttagggagtt
26461 taagattgta cactttattc cctaattgaa acgaccaata gtctaatttt gcagccgtaa
26521 tagaatctgt gaaatgggtc atattatcac ctattgccag gtacatacta atattagcat
26581 ccttatacgg aaggcgtacc atatcatatt cttcgtcatc gattgtgatt gtatttcctt
26641 gcaatttagt aactacgttc atcatgggaa ccgttttcgt accgtactta ttagtaaaac
26701 tagcattgcg tgttttagtg atatcaaacg gatattgcca tatacctttta aaatatatag
26761 tattaatgat tgcccataga gtattattgt cgagcatatt agaatctact acattagaca
26821 taccggatct acgttctact atagaattaa ttttattaac cgcatctcgt ctaaagttta
26881 atctatatag gccgaatcta tgatattgtt gataatacga cggtttaatg cacacagtat
26941 tatctacgaa actttgataa gttagatcag tgtacgtata tttagatgtt ttcagcttag
27001 ctaatcctga tattaattct gtaaatgctg gacccagatc tctttttctc aaatccatag
27061 tcttcaataa ttctattcta gtattacctg atgcaggcaa tagcgacata aacatagaaa
27121 acgaataacc aaacggtgag aagacaatat tatcatcttg aatattttta tacgctacta
27181 taccggcatt ggtaaatcct tgcagacgat aggtagacac tgaacacgtt aacgatagta
27241 tcaataacgc aatcatgatt ttatggtatt aataattaac cttattttta tgttcggtat
27301 aaaaattatt gatgtctaca catccttttg taattgacat ctatatatcc ttttgtataa

FIG. 23 (CONT.)

```
27361 tcaactctaa tcactttaac ttttacagtt ttccctacca gtttatccct atattcaaca
27421 tatctatcca tatgcatctt aacactctct gccaagatag cttcaaagtg aggatagtca
27481 aaaagataaa tatatagagc ataatccttc tcgtatactc tgccctttat tacatcaccc
27541 gcattgggca acgaataaca aaatgcaagc atcttgttaa cgggctcgta aattgggata
27601 aaaattatgt ttttatatct attttattca agagaatatt caggaatttc tttttccggt
27661 tgtatctcat cgcagtatat atcatttgta cattgtttca tattttttaa tagtctacac
27721 cttttagtag gactagtatc gtacaattca tagctgtatt ttgaattcca atcacgcata
27781 aaaatatctt ccaattgttg acgaagacct aatccatcat ccggtgtaat attaatagat
27841 gctccacatg tatccgtaaa gtaatttcct gtccaatttg aggtacctat atacgccgtt
27901 ttatcggtta ccatatattt ggcatggttt accctagaat acggaatggg aggatcagca
27961 tctggtacaa taaatagctt tacttctata tttatgtttt tagattttag catagcgata
28021 gatcttaaaa agtttctcat gataaacgaa gatcgttgcc agcaactaat caatagctta
28081 actgacactt gtctgtctat agcggctctt cttaattcat cttctatata aggccaaaac
28141 aaaatattgc ctgccttcga ataaataata gggataaagt tcataacaga tacataaacg
28201 aatttactcg catttctgat acatgacaat aaagcggtta aatcattggt tctttccata
28261 gtacatagtt gttgcggtgc agaagcaata aatacagagt gtggaacgcc gcttacgtta
28321 atactaagag gatgatctgt attataatac gacggataaa agtttttcca attatatggt
28381 agattgttaa ctccaagata ccagtatacc tcaaaaattt gagtgagatc cgctgccaag
28441 ttcctattat tgaagatcgc aatacccaat tctttgacct gagttagtga tctccaatcc
28501 atgttagcgc ttcctaaata aatatgtgta ttatcagata tccaaaattt tgtatgaaga
```

FIG. 23 (CONT.)

```
28561 actcctccta ggatatttgt aatatctatg tatcgtactt caactccggc catttgtagt
28621 ctttcaacat cctttaatgg tttgttagat ttattgacgg ctactctaac tcgtactcct
28681 cttttgggta attgtacaat cttgtttaat attatcgtgc cgaaattcgt acccacttca
28741 tccgataaac tccaataaaa agatgatata tctagtgttt ttgtggtatt ggatagaatt
28801 tccctccaca tgttaaatgt agacaaatat actttatcaa attgcatacc tataggaata
28861 gtctctgtaa tcactgcgat tgtattatcc ggattcattt tatttgttaa aagaataatc
28921 ctatatcact tcactctatt aaaaatccaa gtttctattt ctttcatgac tgatttttta
28981 acttcatccg tttccttatg aagatgatgt ttggcacctt cataaatttt tatttctcta
29041 ttacaatttg catgttgcat gaaataatat gcacctaaaa catcgctaat cttattgttt
29101 gttccctgga gtatgagagt cggggggtgt taatcttgga aattattttt ctaaccttgt
29161 tggtagcctt caagacctga ctagcaaatc cagccttaat tttttcatga ttgattaatg
29221 ggtcgtattg gtatttataa actttatcca tatctctaga tactgattct ggacatagct
29281 ttccgactgg cgcatttagt gtgatggttc ccataagttt ggcagctagc agattcagtt
29341 ttgaaacagc atctgcatta actagaggag acattagaat cattgctgta aacaagtttg
29401 gattatcgta agaggctagc tcccatggaa tgacccaata agtagattta atagttacca
29461 cgtgctgtac caaagtcatc aatcatcatt ttttcaccat tacttcttcc atgtccaata
29521 tgatcatgtg agaatactaa aattcctaac gatgatatgt tttcagctag ttcgtcataa
29581 cgtccagaat gtttaccagc tccatgactt atgaatacta atgccttagg atatgtaata
29641 ggtttccaat atatgtaatc attgtccaga ttgaacatac agtttgcact catgattcac
29701 gttatataac tatcaatatt aacagttcgt ttgatgatca tattattttt atgttttatt
```

FIG. 23 (CONT.)

```
29761 gataattgta aaaacataca attaaatcaa tatagaggaa ggagacggct actgtctttt
29821 gtgagatagt catggcgact aaattagatt atgaggatgc tgttttttac tttgtggatg
29881 atgataaaat atgtagtcgc gactccatca tcgatctaat agatgaatat attacgtgga
29941 gaaatcatgt tatagtgttt aacaaagata ttaccagttg tggaagactg tacaaggaat
30001 tgatgaagtt cgatgatgtc gctatacggt actatggtat tgataaaatt aatgagattg
30061 tcgaagctat gagcgaagga gaccactaca tcaattttac aaaagtccat gatcaggaaa
30121 gtttattcgc taccatagga atatgtgcta aaatcactga acattgggga tacaaaaaga
30181 tttcagaatc tagattccaa tcattgggaa acattacaga tctgatgacc gacgataata
30241 taaacatctt gatacttttt ctagaaaaaa aattgaattg atgatatagg ggtcttcata
30301 acgcataatt attacgttag cattctatat ccgtgttaaa aaaaattatc ctatcatgta
30361 tttgagagtt ttatatgtag caaacatgat agctgtgatg ccaataagct ttagatattc
30421 acgcgtgcta gtgttaggga tggtattatc tggtggtgaa atgtccgtta tataatctac
30481 aaaataatca tcgcatatag tatgcgatag tagagtaaac atttttatcg tttctactgg
30541 gttcatacat cgtctaccca attcggttat aaatgaaatt gtcgccaatc ttacacccaa
30601 ccccttgtta tccattagta tagtattaac ttcgttattt atgtcataaa ctgtaaatga
30661 ttttgtagat gccatatcat acatgatatt catgtcccta ttataatcat tactaacttt
30721 atcacaatat atgttgataa tatctatata tgatctagtc tttgtgggca actgtctata
30781 caagtcgtct aaacgttgtt tactcatata gtatcgaaca gccatcatta catggtcccg
30841 ttccgttgat agataatcga gtatgttagt ggacttgtca aatctatata ccatattttc
30901 tggaagtgga tatacatagt cgtgatcaac attattgcta gcctcatctt ctatatcctg
30961 tactatacca ttatctatat catctacata atctacgata ttattacaca taaacatcga
```

FIG. 23 (CONT.)

31021 caacatacta ttgtttatta tctaagtcct gttgatccaa acccttgatc tcctctattt
31081 gtactatcta gagattgtac ttcttccagt tctggataat atatacgttg atagattagc
31141 tgagctattc tatctccagt atttacatta aacgtacatt ttccattatt aataagaatg
31201 actcctatgt ttcccctata atcttcgtct attacaccgc ctcctatatc aatgcctttt
31261 agggacagac cagacctagg agctattcta ccatagcaga acttaggcat ggacatacta
31321 atatctgtct taattaactg tcgttctcct ggagggatag tataatcgta agcgctatat
31381 aaatcatatc cggcggcgta aggtgattgc ctagtaggag atttagctct gttagtttcc
31441 ttaacaaatc taactggtga gttaatattc atgttgaaca taaaactaat attttatttc
31501 aaaattattt accatcccat atattccatg aataagtgtg atgattgtac acttctatag
31561 tatctatata cgattcacga taaaatcctc ctatcaatag cagtttatta tccactatga
31621 tcaattctgg attatccctc ggataaatag gatcatctat cagagtccat gtattgctgg
31681 attcacaata aaattccgca tttctaccaa ccaagaataa ccttctaccg aacactaacg
31741 cgcatgattt ataatgagga taataagtgg atggtccaaa ctgccactga tcatgattgg
31801 gtagcaaata ttctgtagtt gtatcagttt cagaatgtcc tcccattacg tatataacat
31861 tgtttatgga tgccactgct ggattacatc taggtttcag aagactcggc atattaaccc
31921 aagcagcatc cccgtggaac caacgctcaa cagatgtggg atttggtaga cctcctacta
31981 cgtataattt attgttagcg ggtatcccgc tagcatacag tctggggcta ttcatcggag
32041 gaattggaat ccaattgttt gatatataat ttaccgctat agcattgtta tgtatttcat
32101 tgttcatcca tccaccgatg agatatacta cttctccaac atgagtactt gtacacatat
32161 ggaatatatc tataatttga tccatgttca taggatactc tatgaatgga tacttgtatg

FIG. 23 (CONT.)

32221 atttgcgtgg ttgtttatca caatgaaata ttttggtaca gtctagtatc cattttacat
32281 tatttatacc tctgggagaa agataatttg acctgattac atttttgata aggagtagca
32341 gatttcctaa tttatttctt cgctttatat accacttaat gacaaaatca actacataat
32401 cctcatctgg aacatttagt tcatcgcttt ctagaataag tttcatagat agataatcaa
32461 aattgtctat gatgtcatct tccagttcca aaaagtgttt ggcaataaag tttttagtat
32521 gacataagag attggatagt ccgtattcta tacccatcat gtaacactcg acacaatatt
32581 cctttctaaa atctcgtaag ataaagttta tacaagtgta gatgataaat tctacagagg
32641 ttaatataga agcacgtaat aaattgacga cgttatgact atctatatat acctttccag
32701 tatacgagta aataactata gaagttaaac tgtgaatgtc aaggtctaga caaacccttg
32761 taactggatc tttatttttc gtgtattttt gacgtaaatg tgtgcgaaag taaggagata
32821 actttttcaa tatcgtagaa ttgactatta tattgccacc tatagcatca ataattgttt
32881 tgaatttctt agtcatagac aatgctaata tattcttaca gtacacagta ttaacaaata
32941 tcggcattta tgtttcttta aaagtcaaca tctaaagaaa aatgattatc ttcttgagac
33001 ataactccca ttttttggta ttcacccaca cgtttttcga aaaaattagt ttttccttcc
33061 aatgatatat tttccatgaa atcaaacgga ttggtaacat tataaatttt tttaaatccc
33121 aattcagaaa tcaatctatc cgcgacgaat tctatatatg ttttcatcat ttcacaattc
33181 attcctataa gtttaactgg aagagccgca gtaagaaatt cttgttcaat ggataccgca
33241 tctgttataa tagatctaac ggtttcttca ctcggtggat gcaataaatg tttaaacatc
33301 aaacatgcga aatcgcagtg cagaccctcg tctctactaa ttagttcgtt ggaaaacgtg
33361 agtccgggca ttaggccacg ctttttaagc caaaatatgg aagcgaatga tccagaaaag

FIG. 23 (CONT.)

```
33421 aagattcctt ctactgcagc aaaggcaata agtctctctc cataaccggc gctgtcatgt
33481 atccactttt gagcccaatc ggccttcttt tttacacaag gcatcgtttc tatggcatta
33541 aagagatagt ttttttcatt actatcttta acataagtat cgatcaaaag actatacatt
33601 tccgaatgaa tgttttcaat ggccatctga aatccgtaga aacatctagc ctcggtaatc
33661 tgtacttctg tacaaaatcg ttccgccaaa ttttcattca ctattccgtc actggctgca
33721 aaaaacgcca atacatgttt tataaaatat ttttcgtctg gtgttagttt attccaatca
33781 ttgatatctt tagatatatc tacttcttcc actgtccaaa atgatgcctc tgccttttta
33841 tacatgttcc agatgtcata atattggatt gggaaaataa caaatctatt tggatttggt
33901 gcaaggatgg gttccataac taaattaaca ataacaataa attttttttc agttatctat
33961 atgcctgtac ttggatcttt tgtacatcga tatcgccgca atcactacaa taattacaag
34021 tattattgat agcattgtta ttagtactat cataattaaa ttatcgacat tcatgggtgc
34081 tgaataatcg ttattatcat cattatcatt ttgtaattgt gacatcatac tagataaatc
34141 gtttgcgaga ttgttgtggg aagcgggcat ggaggatgaa ttatcgttat tattatttaa
34201 cgcctcccat tcggattcac aaatgttacg cacattcaac attttatgga aactataatt
34261 ttgtgaaaac agataacaag aaaactcgtc atcgttcaaa tttttaacga tagtaaaccg
34321 attaaacgtc gagctaattt ctaacgctag cgactctgtt ggatatgggt ttccagatat
34381 atatcttttc agttccccta cgtatctata atcatctgta ggaaatggaa gatatttcca
34441 tttatctact gttcctaata tcatatgtgg tggtgtagta gaaccattaa gcgcgaaaga
34501 tgttatttcg catcgtattt taacttcgca ataatttctg gttagataac gcactctacc
34561 agtcaagtca atgatattag cctttacaga tatattcata gtagttgtaa cgatgactcc
34621 atcttttaga tgcgatactc ctttgtatgt accagaatct tcgtaccgca aactcgatat
```

FIG. 23 (CONT.)

34681 atttaaacaa gttaatgaga tattaacgcg ttttatgaat gatgatatat aaccagaagt
34741 tttatcctcg gtggctagcg ctataacctt atcattataa taccaactag tgtgattaat
34801 atgtgacacg ttagtgtggg tacaaatatg tacattatcg tctacgtcgt attcgataca
34861 tccgcataca gccaacaaat ataaaatgac aaatactcta acgccgttcg tacccatctt
34921 gatgcggttt aataaatgtt ttgatttcaa tttattgtaa aaaaagattc ggttttatac
34981 tgttcgatat tctcattgct tatattttca tctatcatct ccacacagtc aaatccgtgg
35041 ttagcatgca cctcatcaac cggtaaaaga ctatcggact cttctatcat tataactcta
35101 gaatatttaa tttggtcatt attaatcaag tcaattatct tatttttaac aaacgtgagt
35161 attttactca tttttataa aaacttttag aaatatacag actctatcgt gtgtctatat
35221 cttcttttta tatccaatgt atttatgtct gatttttctt catttatcat atataatggt
35281 ccaaattcta cacgtgcttc ggattcatcc agatcattaa ggttcttata attgtaacat
35341 ccttctcttc cctcttctac atcttccttc ttattcttat tcttagcgtc acagaatcta
35401 ccacagcagg atcccatgac gagcgtcata ttaaactaat ccattttcaa ttataatata
35461 cgattagtaa tgaccattaa aataaaaaat attcttcata accggcaaga aagtgaaaag
35521 ttcacattga aactatgtca gtagtataca tcatgaaatg atgatatata tatactctat
35581 tttggtggag gattatatga tataattcgt ggataatcat tcttaagaca catttcttca
35641 ttcgtaaatc ttttcacgtt aaatgagtgt ccatattttg caatttcttc atatgatggc
35701 ggtgtacgtg gacgaagctg ctcctgttct tgttgtagtc gccgactgtc gtgtttgcgt
35761 ttagatccct ccattatcgc gattgcgtag atggagtact attatatacc ttgtaattaa
35821 atttttttat taattaaacg tataaaaacg ttccgtatct gtatttaaga gccagatttc

FIG. 23 (CONT.)

```
35881 gtctaataga acaaatagct acagtaaaaa taactagaat aattgctaca cccactagaa
35941 accacggatc gtaatacggc aatcggtttt cgataatagg tggaacgtat attttattta
36001 aggacttaac aattgtctgt aaaccacaat ttgcttccgc ggatcctgta ttaactatct
36061 gtaaaagcat atgttgaccg ggcggagccg aacattctcc gatatctaat ttctgtatat
36121 ctataatatt attaacctcc gcatacgcat tacagttctt ttctagcttg gataccgcac
36181 taggtacatc gtctagatct attcctattt cttcagcgat agctcttcta tccttttccg
36241 gaagcaatga aatcacttca ataaatgatt caaccatgag tgtgaaacta agtcgagaat
36301 tactcatgca tttgttagtt attcggagcg cgcaattttt aaactgtcct ataacctctc
36361 ctatatgaat agcacaagtg acattagtag ggatagaatg ttgagctaat ttttgtaaat
36421 aactatctat aaaaagatta tacaaagttt taaactcttt agtttccgcc atttatccag
36481 tctgagaaaa tgtctctcat aataaatttt tccaagaaac taattgggtg aagaatggaa
36541 acctttaatc tatatttatc acagtctgtt ttggtacaca tgatgaattc ttctaatgct
36601 gtactaaatt cgatatcttt ttcgatttct ggatatgttt ttaataaagt atgaacaaag
36661 aaatggaaat cgtaatacca gttatgttca actttgaaat tgttttttat tttcttgtta
36721 atgattccag ccacttggga aaagtcaaag tcgtttaatg ccgatttaat acgttcatta
36781 aaaacaaact ttttatcctt tagatgaatt attattggtt cattggaatc aaaaagtaag
36841 atattatcgg gtttaagatc tgcgtgtaaa aagttgtcgc aacagggtag ttcgtagatt
36901 ttaatgtata acagagccat ctgtaaaaag ataaacttta tgtattgtac caaagattta
36961 aatcctaatt tgatagctaa ctcggtatct actttatctg ccgaatacag tgctagggga
37021 aaaattataa tatttcctct ttcgtattcg tagttagttc tcttttcatg ttcgaaaaag
```

FIG. 23 (CONT.)

37081 tgaaacatgc ggttaaaata gtttataaca ttaatattac tgttaataac tgccggataa
37141 aagtgggata gtaatttcac gaatttgata ctgtcctttc tctcgttaaa cgcctttaaa
37201 aaaactttag aagaatatct caatgagagt tcctgaccat ccatagtttg tatcaataat
37261 agcaacatat gaagaacccg tttatacaga gtatgtaaaa atgttaattt atagtttaat
37321 cccatggccc acgcacacac gattaatttt ttttcatctc cctttagatt gttgtataga
37381 aatttgggta ctgtgaactc cgccgtagtt tccatgggac tatataattt tgtggcctcg
37441 aatacaaatt ttactacata gttatctatc ttaaagacta taccatatcc tcctgtagat
37501 atgtgataaa aatcgtcgtt tataggataa aatcgtttat ccttttgttg gaaaaaggat
37561 gaattaatgt aatcattctc ttctatcttt agtagtgttt ccttattaaa attcttaaaa
37621 taatttaaca atctaactga cggagcccaa ttttggtgta aatctaattg ggacattatg
37681 ttgttaaaat acaaacagtc tcctaatata acagtatctg ataatctatg gggagacatc
37741 cattgatatt caggggatga atcattggca acacccattt attgtacaaa aagccccaat
37801 ttacaaacga aagtccaggt ttgatagaga caaacaatta actattttgt ctctgttttt
37861 aatttctttg gtaatgaaat tattcacaat atcagtatct tctttatcta ccagagattt
37921 tactaacttg ataaccttgg ctgtctcatt caatagggta gtaatatttg tatgtgtgat
37981 attgatatct ttttgaattg tttcttttag aagtgattct ttgatggtgc cagcatacga
38041 attacaataa tgcagaaact cagttaacat gcaggaatta tagtaagcca attccaattg
38101 ttgcctgtat tgtattagag tattaatatg cgcaatggtg tccttgcgtt tctctgatag
38161 aatgcgagca gcgattttgg cgttatcatt tgacgatatt tctggaatga cgaatcctgt
38221 ttctactaac tttttggtag gacaaagtga aacaatcaag aagatagctt ctcctcctat
38281 ttgtggaaga aattgaactc ctctagatga tctactgacg atagtatctc cttgacagat

FIG. 23 (CONT.)

38341 attggaccga attacagaag tacctggaat gtaaagccct gaaacccct catttttaa
38401 gcagattgtt gccgtaaatc ctgcactgtg accaagatag agagctcctt tggtgaatcc
38461 atctctatgt ttcagtttaa ccaagaaaca gtcagctggt ctaaaatttc catctctatc
38521 taatacagca tctaacttga tgtcaggaac tatgaccggt ttaatgttat atgtaacatt
38581 gagtaaatcc ttaagttcat aatcatcact gtcatcagtt atgtacgatc caaacaatgt
38641 ttctactggc atagtggata cgaagatgct atccatcaga atgtttccct gattagtatt
38701 ttctatatag ctattcttct ttaaacgatt ttccaaatca gtaactatgt tcattttttt
38761 aggagtagga cgcctagcca gtatggaaga ggattttcta gatcctctct tcaacatctt
38821 tgatctcgat ggaatgcaaa accccatagt gaaacaacca acgataaaaa taatattgtt
38881 tttcactttt tataatttta ccatctgact catggattca ttaatatctt tataagagct
38941 actaacgtat aattctttat aactgaactg agatatatac accggatcta tggtttccat
39001 aattgagtaa atgaatgctc ggcaataact aatggcaaat gtatagaaca acgaaattat
39061 actagagttg ttaaagttaa tattttctat gagctgttcc aataaattat ttgttgtaac
39121 tgcgttcaag tcataaatca tcttgatact atccagtaaa ccgtgtttaa gttctggaat
39181 attatcatcc cattgtaaag cccctaattc gactatcgaa tatcctgctc tgatagcagt
39241 ttcaatatcg acggacgtca atactgtaat aaaggtggta gtattgtcat catcgtgata
39301 aactacggga atatggtcgt tagtaggtac ggtgacttta cacaacgcga tatataactt
39361 tcctttgta ccatttttaa cgtagttggg acgtcctgca gggtattgtt ttgaagaaat
39421 gatatcgaga acagatttga tacgatattt gttggattcc tgattattca ctataatata
39481 atctagacag atagatgatt cgataaatag agaaggtata tcgttggtag gataatacat

FIG. 23 (CONT.)

39541 ccccattcca gtattctcgg atactctatt gatgacacta gttaagaaca tgtcttctat
39601 tctagaaaac gaaaacatcc tacatggact cattaaaact tctaacgctc ctgattgtgt
39661 ctcgaatgcc tcgtacaagg atttcaagga tgccatagat tctttgacca acgatttaga
39721 attgcgttta gcatctgatt tttttattaa atcgaatggt cggctctctg gtttgctacc
39781 ccaatgataa caatagtctt gtaaagataa accgcaagaa aatttatacg catccatcca
39841 aataacccta gcaccatcgg atgatattaa tgtattatta tagattttcc atccacaatt
39901 attgggccag tatactgtta gcaacggtat atcgaataga ttactcatgt aacctactag
39961 aatgatagtt cgtgtactag tcataatatc tttaatccaa tctaagaaat ttaaaattag
40021 attttttaca ctgttaaagt taacaaaggt attacccgga tacgtggata tcatatatgg
40081 cattggtcca ttatcagtaa tagctccata aactgatacg gcgatggttt ttatatgtgt
40141 ttgatctaac gaggaagaaa ttcgcgccca caattcatct ctagatatgt atttaatatc
40201 aaacggtaac acatcaattt cgggacgcgt atatgtttct aaatttttaa tccaaatata
40261 atgatgacct atatgcccta ttatcatact gtcaactata gtacacctag agaacttacg
40321 atacatctgt ttcctataat cgttaaattt tacaaatcta taacatgcta aaccttttga
40381 cgacagccat tcattaattt ctgatatgga atctgtattc tcgataccgt attgttctaa
40441 agccagtgct atatctccct gttcgtggga acgctttcgt ataatatcga tcaacggata
40501 atctgaagtt tttggagaat aatatgactc atgatctatt tcgtccataa acaatctaga
40561 cataggaatt ggaggcgatg atcttaattt tgtgcaatga gtcgtcaatc ctataacttc
40621 taatcttgta atattcatca tcgacataat actatctatg ttatcatcgt atattagtat
40681 accacggcct tcttcatttc gtgccaaaat aatatacagt cttaaataat tacgcaatat

FIG. 23 (CONT.)

40741 ctcaatagtt tcataattgt tagctgtttt catcaagatt tgtaccctgt ttaacatgat
40801 ggcgttctat acgtctctat tttctttttt ttaaattttt aacgatttac tgtggctaga
40861 tacccaatct ctctcaaata tttttttagc ctcgcttaca agctgtttat ctatactatt
40921 aaaactgacg aatccgtgat tttggtaatg ggttccgtcg aaatttgccg aagtgatatg
40981 aacatattcg tcgtcgacta tcaacaattt tgtattattc tgaatagtga aaaccttcac
41041 agatagatca ttttgaacac acaacgcgtc tagacttctg gcggttgcca tagaatatac
41101 gtcgttctta tcccaattac caactagaag tctgatctta actcctctat taatggctgc
41161 ttctataatg gagttgtaaa tgtcgggcca atagtagcta ttaccgtcga cacgtgtagt
41221 gggaactatg gccaaatgtt caatatctat actagtctta gccgacttga gtttatcaat
41281 aactacatcg gtatctagat ctctagaata tcccaatagg tgttccggag aatcagtaaa
41341 gaacactcca cctataggat tcttaatatg atacgcagtg ctaactggca aacaacaagc
41401 cgcagagcat aaattcaacc atgaattttt tgcgctatta aaggctttaa aagtatcaaa
41461 tcttctacga agatctgtgg ccagcggggg ataatcagaa tatacaccta acgttttaat
41521 cgtatgtata gatcctccag taaatgacgc gtttcctaca taacatcttt catcatctga
41581 cacccaaaaa caaccgagta gtagtcccac attatttttt ttatctatat taacggttat
41641 aaaatttata tccgggcagt gactttgtag ctctcccaga tttcttttcc ctcgttcatc
41701 tagcaaaact attattttaa tccctttttc agatgcctct tttagtttat caaaaataag
41761 cgctccccta gtcgtactca gaggattaca acaaaaagat gctatgtata tatatttctt
41821 agctagagtg ataatttcgt taaaacattc aaatgttgtt aaatgatcgg atctaaaatc
41881 catattttct ggtagtgttt ctaccagcct acattttgct cccgcaggta ccgatgcaaa
41941 tggccacatt tagttaacat aaaaacttat acatcctgtt ctatcaacga ttctagaata

FIG. 23 (CONT.)

```
42001 tcatcggcta tatcgctaaa attttcatca aagtcgacat cacaacctaa ctcagtcaat
42061 atattaagaa gttccatgat gtcatcttcg tctatttcta tatccgtatc cattgtagat
42121 tgttgaccga ttatcgagtt taaatcatta ctaatactca atccttcaga atacaatctg
42181 tgtttcattg taaatttata ggcggtgtat ttaagttggt agattttcaa ttatgtatca
42241 atatagcaac agtagttctt gctcctcctt gattctagca tcctcttcat tattttcttc
42301 tacgtacata agcatgtcca atacgttaga caacacaccg acgatggcgg ccgccacaga
42361 cacgaatatg actagaccga tgaccattta aaaacccctc tctagctttc acttaaactg
42421 tatcgattat tcttttagaa catgtataat ataaaaacat tattctattt cgaatttagg
42481 cttccaaaaa tttttcatcc gtaaaccgat aataatatat atagacttgt taatagtcgg
42541 aataaataga ttaatgctta aactatcatc atctccacga ttagagatac aatatttaca
42601 ttttttttgc tgtttcgaaa ctttatcaat acacgttaat acaaacccag gaaggagata
42661 ttgaaactga ggctgttgaa aatgaaacgg tgaatacaat aattcagata atgtaaaatc
42721 atgattccgt attctgatga tattagaact gctaatggat gtcgatggta tgtatctagg
42781 agtatctatt ttaacaaagc atcgatttgc taatatacaa ttatcctttt gattaattgt
42841 tattttattc atattcttaa aaggtttcat atttatcaat tcttctacat taaaaatttc
42901 catttttaat ttatgtagcc cccgcaatac tcctcattac gtttcatttt ttgtctataa
42961 tatccatttt gttcatctcg gtacatagat tatccaattg agaagcgcat ttagtagttt
43021 tgtacatttt aagtttattg acgaatcgtc gaaaactagt tatagttaac attttattat
43081 ttgataccct gatattaata cccctgccgt tactattatt tataactgat gtaatccacg
43141 taacattaga attaattatc gatagtaatg catcgacgct tccaaaattg tctattataa
```

FIG. 23 (CONT.)

```
43201 actcaccgat aattttttta ttgcatgttt tcatattcat taggattatc aaatctttaa
43261 tcttactacg attgtatgcg ttgatattgc aagacgtcat tctaaaagac ggaggatctc
43321 catcaaatgc cagacaatca cgtacaaagt acatggaaat aggttttgtt ctattgcgca
43381 tcatagattt atatagaaca cccgtagaaa tactaatttg ttttactcta taaaatacta
43441 atgcatctat ttcatcgttt tgtataacgt ctttccaagt gtcaaattcc aaattttttt
43501 cattgatagt accaaattct tctatctctt taactacttg catagatagg taattacagt
43561 gatgcctaca tgccgttttt tgaaactgaa tagatgcgtc tagaagcgat gctacgctag
43621 tcacaatcac cactttcata tttagaatat atgtatgtaa aaatatagta gaatttcatt
43681 ttgttttttt ctatgctata aatgaattct cattttgcat ctgctcatac tccgttttat
43741 atcaatacca aagaaggaag atatctggtt ctaaaagccg ttaaagtatg cgatgttaga
43801 actgtagaat gcgaaggaag taaagcttcc tgcgtactca aagtagataa accctcatcg
43861 cccgcgtgtg agagaagacc ttcgtccccg tccagatgcg agagaatgaa taaccctgga
43921 aaacaagttc cgtttatgag gacggacatg ctacaaaata tgttcgcggc taatcgcgac
43981 aacgtggcgt cgagactttt gaactaaaat acaattatat ccttttcgat attaataaat
44041 ccgtgtcgtc caggtttttt atctctttca gtatgtgaat agataggtat tttatctcta
44101 ttcatcatcg aatttaagag atccgataaa cattgtttgt attctccaga tgtcagcatc
44161 tgatacaaca atatatgtgc acataaacct ctggcactta tttcatgtac cttcccctta
44221 tcactaagga gaatagtatt tgagaaatat gtatacatga tattatcatg aattagatat
44281 acagaatttg taacactctc gaaatcacac gatgtgtcgg cgttaagatc taatatatca
44341 ctcgataaca cattttcatc tagatacact agacattttt taaagctaaa atagtcttta
```

FIG. 23 (CONT.)

```
44401 gtagtgacag taactatgcg attattttca tcgatgatac atttcatcgg catattatta
44461 cgcttaccat caaagactat accatgtgta tatctaacgt attctagcat ggttgccata
44521 cgcgcattaa acttttcagg atctttggat agatcttcca atctatctat ttgagaaaac
44581 atttttatca tgttcaatag ttgaaacgtc ggatccacta tatagatatt atctataaag
44641 attttaggaa ctacgttcat ggtatcctgg cgaatattaa aactatcaat gatatgatta
44701 tcgttttcat cttttatcac catatagttt ctaagatatg ggattttact taatataata
44761 ttatttcccg tgataaattt tattagaaag gccaaatcta taagaaaagt tctagaatta
44821 gtctgaagaa tatctatatc gccgtaccgt atatttggat taattagata tagagaatat
44881 gatccgtaac atatacaact tttattatgg cgtctaagat attcttccat caacttatta
44941 acatttttga ctagggaaga tacattatga cgtcccatta cttttgcctt gtctattact
45001 gcgacgttca tagaatttag catatctctt gccaattctt ccattgatgt tacattataa
45061 gaaattttag atgaaattac atttggagct ttaatagtaa gaactcctaa tatgtccgtg
45121 tatgtggtca ctaatacaga ttgtagttct ataatcgtaa ataatttacc tatattatat
45181 gtttgagtct gtttagaaaa gtagctaagt atacgatctt ttatttctga tgcagatgta
45241 ttaacatcgg aaaaaaatct tttttattc ttttttacta aagatacaaa tatgtctttg
45301 ttaaaaacag ttattttttg aatatttcta gcttgtaatt ttaacatatg atattcgttc
45361 acactaggta ctctgcctaa ataggtttct ataatcttta atgtaatatt aggaagagta
45421 ttctgatcag gattcctatt cattttgagg atttaaaact ctgattattg tctaatatgg
45481 tctctacgca aactttttca cagagcgata gagtttttga taactcgttt ttcttaagaa
45541 atataaaact actgtctcca gagctcgctc tatcttttat tttatttaat tcgatacaaa
45601 ctcctgatac tggttcagaa agtaattcat taattttcag tcctttatag aagatattta
```

FIG. 23 (CONT.)

45661 atatagataa tacaaaattt tcagttcttg atatcgatct gattgatcct agaactagat
45721 atattaataa cgtgctcatt aggcagttta tggcagcttg ataattagat atagtatatt
45781 ccagttcata tttattagat accgcattgc ccagattttg atattctatg aattcctctg
45841 aaaataaatc caaaataact aaacattcta ttttttgtgg attagtgtac tctcttccct
45901 ctatcatgtt cactactggt gtccacgatg ataaatatct agagggaata taatatagtc
45961 cataggatgc caatctagca atgtcgaata actgtaattt gattcttcgt tcttcattat
46021 gaattgattc ttgaggtata aacctaacac aaattatatt attagacttt tcgtatgtaa
46081 tgtctttcat gttataagtt tttaatcctg gaatagaatc tattttaatg aggcttttaa
46141 acgcagagtt ctccaacgag tcaaagcata atactctgtt gtttttctta tatacgatgt
46201 tacgattttc ttctttgaat ggaataggtt tttgaattag tttataatta caacataata
46261 gataaggaag tgtgcaaata gtacgcggaa aaaacataat agctcccctg ttttcatcca
46321 tggttttaag taaatgatca ctggcttctt tagtcaatgg atattcgaac attaaccgtt
46381 tcatcatcat tggacagaat ccatatttct taatgtaaag agtgatcaaa tcattgtgtt
46441 tattgtacca tcttgttgta aatgtgtatt cggttatcgg atctgctcct ttttctatta
46501 aagtatcgat gtcgatctcg tctaagaatt caactatatc gacatatttc atttgtatac
46561 acataaccat tactaacgta gaatgtatag gaagagatgt aacgggaaca gggtttgttg
46621 attcgcaaac tattctaata cataattctt ctgttaatac gtcttgcacg taatctatta
46681 tagatgccaa gatatctata taattatttt gtaagatgat gttaactatg tgatctatat
46741 aagtagtgta ataattcatg tatttcgata tatgttccaa ctctgtcttt gtgatgtcta
46801 gtttcgtaat atctatagca tcctcaaaaa atatattcgc atatattccc aagtcttcag

FIG. 23 (CONT.)

```
46861 ttctatcttc taaaaaatct tcaacgtatg gaatataata atctatttta cctcttctga
46921 tatcattaat gatatagttt ttgacactat cttctgtcaa ttgattctta ttcactatat
46981 ctaagaaacg gatagcgtcc ctaggacgaa ctactgccat taatatctct attatagctt
47041 ctggacataa ttcatctatt ataccagaat taatgggaac tattccgtat ctatctaaca
47101 tagttttaag aaagtcagaa tctaagacct gatgttcata tattggttca tacatgaaat
47161 gatctctatt gatgatagtg actatttcat tctctgaaaa ttggtaactc attctatata
47221 tgctttcctt gttgatgaag gatagaatat actcaataga atttgtacca acaaactgtt
47281 ctcttatgaa tcgtatatca tcatctgaaa taatcatgta aggcatacat ttaacaatta
47341 gagacttgtc tcctgttatc aatatactat tcttgtgata atttatgtgt gaggcaaatt
47401 tgtccacgtt ctttaatttt gttatagtag atatcaaatc caatggagct acagttcttg
47461 gcttaaacag atatagtttt tctggaacga attctacaac attattataa aggactttgg
47521 gtagataagt gggatgaaat cctattttaa ttaatgcgat agccttgtcc tcgtgcagat
47581 atccaaacgc ttttgtgata gtatggcatt cattgtctag aaacgctcta cgaatatctg
47641 tgacagatat catctttaga gaatatacta gtcgcgttaa tagtactaca atttgtattt
47701 tttaatctat ctcaataaaa aaattaatat gtatgattca atgtataact aaactactaa
47761 ctgttattga taactagaat cagaatctaa tgatgacgta accaagaagt ttatctactg
47821 ccaatttagc tgcattattt ttagcatctc gtttagattt tccatctgcc ttatcgaata
47881 ctcttccgtc gatgtctaca caggcataaa atgtaggaga gttactaggc cccactgatt
47941 caatacgaaa agaccaatct ctcctagtaa tttggcagta ctcattaata acggtgacag
48001 ggttagcacc tttccaatca ataatttttt tagccggaat aacatcatca aaagacttat
```

FIG. 23 (CONT.)

48061 gatcctctct cattgatttt tcgcgggata catcatctat tatgacgtca gccatagcat
48121 cagcatccgg cttatccgcc tccgttgtca taaaccaacg aggaggaata tcgtcggagc
48181 tgtacaccat agcactacgt tgaagatcgt acagagcttt attaacttct cgcttctcca
48241 tattaagttg tctagttagt tgtgcagcag tagctccttc gattccaatg gttttaatag
48301 cctcacacac aatctctgcg ttagaacgct cgtcgatata gattttagac atttttagag
48361 agaactaacg caatcagtaa taaaactaat ttattttatc attttttta ttcatcatcc
48421 tctggtggtt cgtcgtttct atcgaatgta gctctgatta acccgtcatc tataggtgat
48481 gctggttctg gagattctgg aggagatgga ttattatctg gaagaatctc tgttatttcc
48541 ttgttttcat gtatcgattg cgttgtaaca ttaagattgc gaaatgctct aaatttggga
48601 ggcttaaagt gttgtttgca atctctacac gcgtgtctaa ctagtggagg ttcgtcagcg
48661 gctctagttt gaatcatcat cggcgtagta ttcctacttt tacagttagg acacggtgta
48721 ttgtatttct cgtcgagaac gttaaaataa tcgttgtaac tcacatcctt tattttatct
48781 atattgtatt ctactccttt cttaatgcat tttataccga ataagagata gcgaaggaat
48841 tctttttcgg tgccgctagt acccttaatc atatcacata gtgttttata ttccaaattt
48901 gtggcaatag acggtttatt tctatacgat agtttgtttc tggaatcctt tgagtattct
48961 ataccaatat tattctttga ttcgaattta gtttcttcga tattagattt tgtattacct
49021 atattcttga tgtagtactt tgatgatttt tccatggccc attctattaa gtcttccaag
49081 ttggcatcat ccacatattg tgatagtaat tctcggatat cagtagcggt taccgccatt
49141 gatgtttgtt cattggatga gtaactacta atgtatacat tttccattta taacacttat
49201 gtattaactt tgttcattta tattttttca ttattatgtt gatattaaca aaagtgaata
49261 tatatatgtt aataattgta ttgtggttat acggctacaa ttttataatt agtgaaagtc

FIG. 23 (CONT.)

49321 agtgtccgat gatcaatgac gatagcttta ctctgaaaag aaagtatcaa atcgatagtg
49381 cggagtcaac aataaaaatg gataagaaga ggacaaagtt tcagaataga gccaaaatgg
49441 taaaagaaat aaatcagaca ataagagcag cacaaactca ttacgagaca ttgaaactag
49501 gatacataaa atttaagaga atgattagga ctactactct agaagatata gcaccatcta
49561 ttccaaataa tcagaaaact tataaactat tctcggacat ttcagccatc ggcaaagcat
49621 cacggaatcc aagtaagatg gtatatgctc tgctgcttta catgtttccc aatttgtttg
49681 gagatgatca tagattcatt cgttatagaa tgcatccaat gagtaaaatc aaacacaaga
49741 tcttctctcc tttcaaactt aatcttatta gaatattagt ggaagaaaga ttctataata
49801 atgaatgcag atctaataaa tggagaataa ttggaacaca agttgataaa atgttgatag
49861 ctgaatctga taaatataca atagatgcaa ggtataacct aaaacccatg tatagaatca
49921 agggaaaatc tgaagaagat accctcttta tcaaacagat ggtagaacaa tgtgtgacat
49981 cccaggaatt ggtggaaaaa gtgttgaaga tactgtttag agatttgttc aagagtggag
50041 aatacaaagc gtacagatac gatgatgatg tagaaaatgg atttattgga ttggatacac
50101 taaaattaaa cattgttcat gatatagttg aaccatgtat gcctgttcgt aggccagtgg
50161 ctaagatact gtgtaaagaa atggtaaata aatactttga gaatccgcta catattattg
50221 gtaaaaatct tcaagagtgc attgactttg ttagtgaata ggcatttcat ctttctccaa
50281 tactaattca aattgttaaa ttaataatgg atagtataaa tagttattag tgataaaata
50341 gtaaaaataa ttattagaat aagagtgtag tatcatagat aactctcttc tataaaaatg
50401 gattttattc gtagaaagta tcttatatac acagtagaaa ataatataga tttttaaag
50461 gatgatacat taagtaaagt aaacaatttt accctcaatc atgtactagc tctcaagtat

FIG. 23 (CONT.)

```
50521 ctagttagca attttcctca acatgttatt actaaggatg tattagctaa taccaatttt
50581 tttgttttca tacatatggt acgatgttgt aaagtgtacg aagcggtttt acgacacgca
50641 tttgatgcac ccacgttgta cgttaaagca ttgactaaga attatttatc gtttagtaac
50701 acaatacaat cgtacaagga aaccgtgcat aaactaacac aagatgaaaa atttttagag
50761 gttgccaaat acatggacga attaggagaa cttataggcg taaattatga cttagttctt
50821 aatccattat ttcacggagg ggaacccatc aaagatatgg aaatcatttt tttaaaactg
50881 tttaagaaaa cagacttcaa agttgttaaa aaattaagtg ttataagatt acttatttgg
50941 gcttacctaa gcaagaaaga tacaggcata gagtttgcgg ataatgatag acaagatata
51001 tatactctat ttcaacaaac tggtagaatc gtccatagca atctaacaga aacgtttaga
51061 gattatatct ttcccggaga taagactagc tattgggtgt ggttaaacga aagtatagct
51121 aatgatgcgg atattgttct taatagacac gccattacca tgtatgataa aattcttagt
51181 tatatatact ctgagataaa acaaggacgc gttaataaaa acatgcttaa gttagtttat
51241 atctttgagc ctgaaaaaga tatcagagaa cttctgctag aaatcatata tgatattcct
51301 ggagatatcc tatctattat tgatgcaaaa aacgacgatt ggaaaaaata ttttattagt
51361 ttttataaag ctaattttat taacggtaat acatttatta gtgatagaac gtttaacgag
51421 gacttattca gagttgttgt tcaaatagat cccgaatatt tcgataatga acgaattatg
51481 tctttattct ctacgagtgc tgcggacatt aaacgatttg atgagttaga tattaataac
51541 agttatatat ctaatataat ttatgaggtg aacgatatca cattagatac aatggatgat
51601 atgaagaagt gtcaaatctt taacgaggat acgtcgtatt atgttaagga atacaataca
51661 tacctgtttt tgcacgagtc ggatcccatg gtcatagaga acggaatact aaagaaactg
```

FIG. 23 (CONT.)

51721 tcatctataa aatccaagag tagacggctg aacttgttta gcaaaaacat tttaaaatat
51781 tatttagacg gacaattggc tcgtctaggt cttgtgttag atgattataa aggagacttg
51841 ttagttaaaa tgataaacca tcttaagtct gtggaggatg tatccgcatt cgttcgattt
51901 tctacagata aaaaccctag tattcttcca tcgctaatca aaactatttt agctagttat
51961 aatatttcca tcatcgtctt atttcaaagg tttttaagag ataatctata tcatgtagaa
52021 gaattcttgg ataaaagcat ccatctaacc aagacggata agaaatatat acttcaattg
52081 ataagacacg gtagatcata gaacagacca aatatattat taataatttg tatatacata
52141 gatataatta tcacatatta aaaattcaca catttttgat aaatgggaac tgctgcaaca
52201 attcagactc ccaccaaatt aatgaataaa gaaaatgcag aaatgatttt ggaaaaaatt
52261 gttgatcata tagttatgta tattagtgac gaatcaagtg attcagaaaa taatcctgaa
52321 tatattgatt ttcgtaacag atacgaagac tatagatctc tcattataaa aagtgatcac
52381 gagtttgtaa agctatgtaa aaatcatgca gagaaaagtt ctccagaaac gcaacaaatg
52441 attatcaaac acatatacga acaatatctt attccagtat ctgaagtact attaaaacct
52501 ataatgtcca tgggtgacat aattacatat aacggatgta aagacaatga atggatgcta
52561 gaacaactct ctaccctaaa ctttaacaat ctccgcacat ggaactcatg tagcataggc
52621 aatgtaacgc gtctgtttta tacatttttt agttatctga tgaaagataa actaaatata
52681 taagtataat cccattctaa tactttaacc tgatgtatta gcatcttatt agaatattaa
52741 cctaactaaa agacataaca taaaaactca ttacatagtt gataaaaagc ggtaggatat
52801 aaatattatg gctgccaccg ttccgcgttt tgacgacgtg tacaaaaatg cacaaagaag
52861 aattctagat caagaaacat tttttagtag aggtctaagt agaccgttaa tgaaaaacac
52921 atatctattt gataattacg cgtatggatg gataccagaa actgcaattt ggagtagtag

FIG. 23 (CONT.)

52981 atacgcaaac ttagatgcaa gtgactatta tcccatttcg ttgggattac ttaaaaagtt
53041 cgagtttctc atgtctctat ataaaggtcc tattccagta tacgaagaaa aagtaaatac
53101 tgaattcatt gctaatggat cgttctctgg tagatacgta tcatatcttc gaaagttttc
53161 tgctcttcca acaaacgagt ttattagttt tttgttactg acttccattc caatctataa
53221 tatcttgttc tggtttaaaa atactcagtt tgatattact aaacacacat tattcagata
53281 cgtctataca gataatgcca aacacctggc gttggctagg tatatgcatc aaacaggaga
53341 ctataagcct ttgtttagtc gtctcaaaga gaattatata tttaccggtc ccgttccaat
53401 aggtatcaaa gatataaatc accctaatct tagtagagca agaagtccat ccgattatga
53461 gacattagct aatattagta ctatattgta ctttaccaag tatgatccgg tattaatgtt
53521 tttattgttt tacgtacctg ggtattcaat tactacaaaa attactccag ccgtagaata
53581 tctaatggat aaactgaatc taacaaagag cgacgtacaa ctgttgtaaa ttattttatg
53641 cttcgtaaaa tgtaggtttt gaaccaaaca ttctttcaaa gaatgagatg cataaaactt
53701 tattatccaa tagattgact atttcggacg tcaatcgttt aaagtaaact tcgtaaaata
53761 ttctttgatc actgccgagt ttaaaacttc tatcgataat tgtttcatat gttttaatat
53821 ttacaagttt tttggtccat ggtacattag ccggacaaat atatgcaaaa taatatcgtt
53881 ctccaagttc tatagtttct ggattatttt tattatattc agtaaccaaa tacatattag
53941 ggttatctgc ggatttataa tttgagtgat gcattcgact caacataaat aattctagag
54001 gagacgatct actatcaaat tcggatcgta aatctgtttc taaagaacgg agaatatcta
54061 tacatacctg attagaattc atccgtcctt cagacaacat ctcagacagt ctggtcttgt
54121 atgtcttaat catattctta tgaaacttgg aaacatctct tctagtttca ctagtacctt

FIG. 23 (CONT.)

```
54181 tattaattct ctcaggtaca gattttgaat tcgacgatgc cgagtatttc atcgttgtat
54241 atttcttctt cgattgcata atcagattct tatataccgc ctcaaactct attttaaaat
54301 tattaaacaa tactctatta ttaatcagtc gttctaactc ctttgctatt tctatggact
54361 tatctacatc ttgactgtct atctctgtaa acacggagtc ggtatctcca tacacgctac
54421 gaaaacgaaa tctgtaatct ataggcaacg atgttttcac aatcggatta atatctctat
54481 cgtccatata aaatggatta cttaatggat tggcaaaccg taacataccg ttagataact
54541 ctgctccatt tagtaccgat tctagataca agatcattct acgtcctatg gatgtgcaac
54601 tcttagccga agcgtatgag tatagagcac tatttctaaa tcccatcaga ccatatactg
54661 agttggctac tatcttgtac gtatattgca tggaatcata gatggccttt tcagttgaac
54721 tggtagcctg ttttaacatc tttttatatc tggctctctc tgccaaaaat gttcttaata
54781 gtctaggaat ggttccttct atcgatctat cgaaaattgc tatttcagag atgaggttcg
54841 gtagtctagg ttcacaatga accgtaatat atctaggagg tggatatttc tgaagcaaga
54901 gctgattatt tatttcttct tccaatctat tggtactaac aacgacaccg actaatgttt
54961 ccggagatag atttccaaag atacacacat taggatacag actgttataa tcaaagatta
55021 atacattatt actaaacatt ttttgttttg gagcaaatac cttaccgcct tcataaggaa
55081 acttttgttt tgtttctgat ctaactaaga tagttttagt ttccaacaat agctttaaca
55141 gtggaccctt gatgactgta ctcgctctat attcgaatac catggattga ggaagcacat
55201 atgttgacgc acccgcgtct gtttttgttt ctactccata atactcccac aaatactgac
55261 acaaacaagc atcatgaata cagtatctag ccatatctaa agctatgttt agattataat
55321 ccttatacat ctgagctaaa tcaacgtcat cctttccgaa agataattta tatgtatcat
```

FIG. 23 (CONT.)

```
55381 taggtaaagt aggacataat agtacgactt taaatccatt ttcccaaata tctttacgaa
55441 ttactttaca tataatatcc tcatcaacag tcacataatt acctgtggtt aaaacctttg
55501 caaatgcagc ggctttgcct ttcgcgtccg tagtatcgtc accgatgaac gtcatttctc
55561 taactcctct atttaatact ttacccatgc aactgaacgc gttcttggat atagaatcca
55621 atttgtacga atccaatttt tcagattttt gaatgaatga atatagatcg aaaaatatag
55681 ttccattatt gttattaacg tgaaacgtag tattggccat gccgcctact cccttatgac
55741 tagactgatt tctctcataa atacagagat gtacagcttc ctttttgtcc ggagatctaa
55801 agataatctt ctctcctgtt aataactcta gacgattagt aatatatctc agatcaaagt
55861 tatgtccgtt aaaggtaacg acatagtcga acgttagttc caacaattgt ttagctattc
55921 gtaacaaaac tatttcagaa cataaaacta gttctcgttc gtaatccatt tccattagtg
55981 actgtatcct caaacatcct ctatcgacgg cttcttgtat ttcctgttcc gttaacatct
56041 cttcattaat gagcgtaaac aataatcgtt taccacttaa atcgatataa cagtaacttg
56101 tatgcgagat tgggttaata aatacagaag gaaacttctt atcgaagtga cactctatat
56161 ctagaaataa gtacgatctt gggatatcga atctaggtat ttttttagcg aaacagttac
56221 gtggatcgtc acaatgataa catccattgt taatctttgt caaatattgc tcgtccaacg
56281 agtaacatcc gtctggagat atcccgttag aaatataaaa ccaactaata ttgagaaatt
56341 catccatggt ggcattttgt atgctgcgtt tctttggctc ttctatcaac cacatatctg
56401 cgacggagca ttttctatct ttaatatcta gattataact tattgtctcg tcaatgtcta
56461 tagttctcat ctttcccaac ggcctcgcat taaatggagg aggagacaat gactgatata
56521 tttcgtccgt cactacgtaa taaaagtaat gaggaaatcg tataaatacg gtctcaccat
56581 ttcgacatct ggatttcaga tataaaaatc tgttttcacc gtgactttca aaccaattaa
```

FIG. 23 (CONT.)

```
56641 tgcaccgaac atccatttat agaatttaga aatatatttt catttaaatg aatcccaaac
56701 attggggaag agccgtatgg accattattt ttatagtact ttcgcaagcg ggtttagacg
56761 gcaacataga agcgtgtaaa cgaaaactat atactatagt tagcactctt ccatgtcctg
56821 catgtagacg gcacgcgact atcgctatag aggacaataa tgtcatgtct agcgatgatc
56881 tgaattatat ttattatttt ttcatcagat tatttaacaa tttggcatct gatcccaaat
56941 acgcgatcga tgtgacaaag gttaaccctt tataaactta acccattata aaacttatga
57001 ttagtcacga ctgaaataac cgcgtgatta tttttggta taattctaca cggcatggtt
57061 tctgtgacta tgaattcaac ccccgttaca ttagtgaaat ctttaacaaa cagcaagggt
57121 tcgtcaaaga cataaaactc attgtttaca atcgaaatag acccctatc acacttaaaa
57181 taaaaaatat ccttatcctt taccaccaaa taaaattctg attggtcaat gtgaatgtat
57241 tcacttaaca gttccacaaa tttatttatt aactccgagg cacatacatc gtcggtattt
57301 tttatggcaa actttactct tccagcatcc gtttctaaaa aaatattaac gagttccatt
57361 tatatcatcc aatattattg aaatgacgtt gatggacaaa tgatacaaat aagaaggtac
57421 ggtacctttg tccaccatct cctccaattc atgctctatt ttgtcattaa ctttaatgta
57481 tgaaaacagt acgccacatg cttccatgac agtgtgtaac actttggata caaaatgttt
57541 gacattagta taattgttca agactgtcaa tctataatag atagtagcta taatatattc
57601 tatgatggta ttgaagaaga tgacaacctt ggcatattga tcatttaaca cagacatggt
57661 atcaacagat agcttgaatg aaagagaatc agtaattgga ataagcgtct tctcgatgga
57721 gtgtccgtat accaacatgt ctgatatttt gatgtattcc attaaattat ttagtttttt
57781 ctttttattc tcgttaaaca gcatttctgt caacggaccc caacatcgtt gaccgattaa
```

FIG. 23 (CONT.)

```
57841 gttttgattg atttttccgt gtaaggcgta tctagtcaga tcgtatagcc tatccaataa
57901 tccatcgtct gtgtgtagat cacatcgtac actttttaat tctctataga agagcgacag
57961 acatctggag caattacaga cagcaatttc tttattctct acagatgtaa gatacttgaa
58021 gacattccta tgatgatgca gaattttgga taacacggta ttgatggtat ctgttaccat
58081 aattcctttg atggctgata gtgtcagagc acaagatttc caatctttga caatttttag
58141 caccattatc tttgttttga tatctatatc agacagcatg gtgcgtctga caacacaagg
58201 attaagacgg aaagatgaaa tgattctctc aacatcttca atggatacct tgctattttt
58261 tctggcatta tctatatgtg cgagaatatc ctctagagaa tcagtatcct ttttgatgat
58321 agtggatctc aatgacatgg gacgtctaaa ccttcttatt ctatcaccag attgcatggt
58381 gatttgtctt ctttctttta tcataatgta atctctaaat tcatcggcaa attgtctata
58441 tctaaaatca taatatgaga tgtttacctc tacaaatatc tgttcgtcca atgttagagt
58501 atttacatca gttttgtatt ccaaattaaa catggcaacg gatttaattt tatattcctc
58561 tattaagtcc tcgtcgataa taacagaatg tagataatca tttaatccat cgtacatggt
58621 tggaagatgc tcgttgacaa aatctttaat tgtcttgatg aaggtgggac tatatctaac
58681 atcttgatta ataaaattta taacattgtc cataggatac tttgtaacta gttttataca
58741 catctcttca tcggtaagtt tagacagaat atcgtgaaca ggtggtatat tatattcatc
58801 agatatacga agaacaatgt ccaaatctat attgtttaat atattatata gatgtagtgt
58861 agctcctaca ggaatatctt taactaagtc aatgatttca tcaaccgtta gatctatttt
58921 aaagttaatc atataggcat tgatttttaa aaggtatgta gccttgacta cattctcatt
58981 aattaaccat tccaagtcac tgtgtgtaag aagattatat tctatcataa gcttgactac
```

FIG. 23 (CONT.)

59041 atttggtccc gataccatta aagaattctt atgatataag gaaacagatt ttaggtactc
59101 atctactcta caagaatttt ggagagcctt aacgatatca gtgacgttta ttatttcagg
59161 aggaaaaaac ctaacattga gaatatcgga attaatagct tccagataca gtgattttgg
59221 caatagtccg tgtaatccat aatccagtaa cacgagctgg tgcttgctag acaccttttc
59281 aatgtttaat ttttttgaaa taagctttga taaagccttc ctcgcaaatt ccggatacat
59341 gaacatgtcg gcgacatgat taagtattgt tttttcatta tttttatatt ttctcaacaa
59401 gttctcaata ccccaataga tgatagaata tcacccaatg cgtccatgtt gtctatttcc
59461 aacaggtcgc tatatccacc aatagaagtt ttcccaaaaa agattctagg aacagttcta
59521 ccaccagtaa tttgttcaaa atagtcacgc aattcatttt cgggtttaaa ttctttaata
59581 tcgacaattt catacgctcc tcttttgaaa ctaaacttat ttagaatatc cagtgcattt
59641 ctacaaaaag gacatgtata cttgacaaaa attgtcactt tgttattggc caacctttgt
59701 tgtacaaatt cctcggccat tttaatattt aagtgatata aaactatctc gacttattta
59761 actctttagt cgagatatat ggacgcagat agctatatga tagccaacta cagaaggcaa
59821 acgctataaa aaacataatt acgacgagca tatttataaa tatttttatt cagcattact
59881 tgatatagta atattaggca cagtcaaaca ttcaaccact ctcgatacat taactctctc
59941 atttctttta acaaattctg caatatcttc gtaaaaagat tcttgaaact ttttagaata
60001 tctatcgact ctagatgaaa tagcgttcgt caacatacta tgttttgtat acataaaggc
60061 gcccatttta acagtttcta gtgacaaaat gctagcgatc ctaggatcct ttagaatcac
60121 atagattgac gattcgtctc tcttagtaac tctagtaaaa taatcataca atctagtacg
60181 cgaaataata ttatccttga cttgaggaga tctaaacaat ctagttttga gaacatcgat
60241 aagttcatcg ggaatgacat acatactatc tttaatagaa ctcttttcat ccagttgaat

FIG. 23 (CONT.)

60301 ggattcgtcc ttaaccaact gattaatgag atcttctatt ttatcatttt ccagatgata
60361 tgtatgtcca ttaaagttaa attgtgtagc gcttcttttt agtctagcag ccaatacttt
60421 aacatcacta atatcgatat acaaaggaga tgatttatct atggtattaa gaattcgttt
60481 ttcgacatct gtcaaaacca attccttttt gcctgtatca tccagttttc catcctttgt
60541 aaagaaatta ttttctacta gactattaat aagactgata aggattcctc cataattgca
60601 caatccaaac tttttcacaa aactagactt tacaagatct acaggaatgc gtacttcagg
60661 tttcttagct tgtgattttt tcttttgtgg acattttctt gtgaccaact catctaccat
60721 ttcattgatt ttagcagtga aataagcttt caatgcacgg gcactgatac tattgaaaac
60781 gagttgatct tcaaattccg ccatttaagt tcaccaaaca acttttaaat acaaatatat
60841 caatagtagt agaataagaa ctataaaaaa aataataatt aaccaatacc aaccccaaca
60901 accggtatta ttagttgatg tgactgtttt ctcatcactt agaacagatt taacaatttc
60961 tataaagtct gtcaaatcat cttccggaga ccccataaat acaccaaata tagcggcgta
61021 caacttatcc atttatacat tgaatattgg cttttcttta tcgctatctt catcatattc
61081 atcatcaata tcaacaagtc ccagattacg agccagatct tcttctacat tttcagtcat
61141 tgatacacgt tcactatctc cagagagtcc gataacgtta gccaccactt ctctatcaat
61201 gattagtttc ttgagtgcga atgtaatttt tgtttccgtt ccggatctat agaaaactac
61261 aggtgtgata attgccttgg ccaattgtct ttctctttta ctgagtgatt ctagttcacc
61321 ttctatagat ctgagaatgg atgattctcc agtcgaaaca tattctacca tggctccgtt
61381 taatttgttg atgaagatgg attcatcctt aaatgttttc tctgtaatag tttccaccga
61441 aagactatgc aaagaatttg gaatgcgttc cttgtgctta atgtttccat agacggcttc

FIG. 23 (CONT.)

```
61501 tagaagttga tacaacatag gactagccgc ggtaactttt atttttagaa agtatccatc
61561 gcttctatct tgtttagatt tatttttata aagtttagtc tctccttcca acataataaa
61621 agtggaagtc atttgactag ataaactatc agtaagtttt atagagatag acgaacaatt
61681 agcgtattga gaagcattta gtgtaacgta ttcgatacat tttgcattag atttactaat
61741 cgattttgca tactctataa cacccgcaca agtctgtaga gaatcgctag atgcagtagg
61801 tcttggtgaa gtttcaactc tcttcttgat taccttactc atgattaaac ctaaataatt
61861 gtactttgta atataatgat atatattttc actttatctc atttgagaat aaaaatgttt
61921 ttgtttaacc actgcatgat gtacagattt cggaatcaca aaccaccggt ggttttattt
61981 tatccttgtc caatgtgaat tgaatgggag cggatgcggg tttcgtacgt agatagtaca
62041 ttcccgtttt tagaccgaga ctccatccgt aaaaatgcat actcgttagt ttggaataac
62101 tcggatctgc tatatggata ttcatagatt gactttgatc gatgaaggct cccctgtctg
62161 cagccatttt tatgatcgtc ttttgtggaa tttcccaaat agttttataa actcgcttaa
62221 tatcttctgg aaggtttgta ttctgaatgg atccaccatc tgccataatc ctattcttga
62281 tctcatcatt ccataatttt ctctcggtta aaactctaag gagatgcgga ttaactactt
62341 gaaattctcc agacaatact ctccgagtgt aaatattact ggtatacggt tccaccgact
62401 cattatttcc caaaatttga gcagttgatg cagtcggcat aggtgccacc aataaactat
62461 ttctaagacc gtatgttctg attttatctt ttagaggttc ccaattccaa agatccgacg
62521 gtacaacatt ccaaagatca tattgtagaa taccgttact ggcgtacgat cctacatatg
62581 tatcgtatgg tccttccttc tcagctagtt cacaactcgc ctctaatgca ccgtaataaa
62641 tggtttcgaa gatcttctta tttagatctt gtgcttccag gctatcaaat ggataattta
```

FIG. 23 (CONT.)

```
62701 agagaataaa cgcgtccgct aatccttgaa caccaatacc gataggtcta tgtctcttat
62761 tagagatttc agcttctgga ataggataat aattaatatc tataatttta ttgagatttc
62821 tgacaattac tttgaccaca tccttcagtt tgagaaaatc aaatcgccca tctattacaa
62881 acatgttcaa ggcaacagat gccagattac aaacggctac ctcattagca tccgcatatt
62941 gtattatctc agtgcaaaga ttactacact tgatagttcc taaattttgt tgattactct
63001 ttttgttaca cgcatcctta taaagaatga atggagtacc agtttcaatc tgagattcta
63061 taatcgcttt ccagacgact cgagccttta ttatagattt gtatctcctt tctctttcgt
63121 atagtgtata caatcgttcg aactcgtctc cccaaacatt gtccaatcca ggacattcat
63181 ccggacacat caacgaccac tctccgtcat ccttcactcg tttcataaag agatcaggaa
63241 tccaaagagc tataaataga tctctggttc tatgttcctc gtttcctgta ttctttttaa
63301 gatcgaggaa cgccataata tcagaatgcc acggttccaa gtatatggcc ataactccag
63361 gccgtttgtt tcctccctga tctatgtatc tagcggtgtt attataaact ctcaacattg
63421 gaataatacc gtttgatata ccattggtac cggagatata gcttccactg gcacgaatat
63481 tactaattga tagacctatt ccccctgcca ttttagagat taatgcgcat cgttttaacg
63541 tgtcatagat accctctatg ctatcatcga tcatgttaag tagaaaacag ctagacattt
63601 ggtgacgact agttcccgca ttaaataagg taggagaagc gtgcgtaaac catttttcag
63661 aaagtagatt gtacgtctca atagctgagt ctatatccca ttgatgaatt cctactgcga
63721 cacgcattaa catgtgctga ggtctttcaa cgatcttgtt gtttattttc aacaagtagg
63781 atttttccaa agttttaaaa ccaaaatagt tgtatgaaaa gtctcgttcg taaataataa
63841 ccgagttgag tttatcctta tatttgttaa ctatatccat ggtgatactt gaaataatcg
63901 gagaatgttt cccattttta ggattaacat agttgaataa atcctccatc acttcactaa
```

FIG. 23 (CONT.)

```
63961 atagtttttt tgtttccttg tgtagatttg atacggctat tctggcggct agaatggcat
64021 aatccggatg ttgtgtagta caagtggctg ctatttcggc tgccagagtg tccaattcta
64081 ccgttgttac tccattatat attccttgaa taaccttcat agctatttta ataggatcta
64141 tatgatccgt gtttaagcca taacataatt ttctaatacg agacgtgatt ttatcaaaca
64201 tgacattttc cttgtatcca tttcgtttaa tgacaaacat ttttgttggt gtaataaaaa
64261 aattatttaa cttttcatta atagggattt gacgtacgta gcgtacaaaa tgattgttcc
64321 tggtatatag ataaagagtc ctatatattt gaaaatcgtt acggctcgat taaactttaa
64381 tgattgcata gtgaatatat cattaggatt taactccttg actatcaggg cggcaccaga
64441 aattaccatc aaaagcatta atacagttat gcctatcgca gttagaacgg ttatagcatc
64501 caccatttat atctaaaaat tagatcaaag aatatgtgac aaagtcctag ttgtatattg
64561 agaattgaca aaacaatgtt tcttacatat ttttttttta ttagtaaccg acttaatagt
64621 aggaactgga aaactagact tgattattct ataagtatag atacccttcc aaataatatt
64681 ctctttgata aaagttccag aaaatgtaga attttttaaa aagttatctt ttgctattac
64741 caagattgtg tttagacgct tattattaat atgagtgatg aaatccacac cgcctctaga
64801 tatcgccttt atttccacat tagatggtaa atccaatagt gaaactatct ttttaggaat
64861 gtatggactc gcgtttagag gagtgaacgt cttgggcgtc ggaaaggatg attcgtcaaa
64921 cgaataaaca atttcacaaa tggatgttaa tgtattagta ggaaattttt tgacgctagt
64981 ggaattgaaa attctaatgg atgatgttct acctatttca tccgataaca tgttaatttc
65041 cgacaccaac ggttttaata tttcgatgat atacggtagt ctctctttcg gacttatata
65101 gcttattcca caatacgagt cattatatac tccaaaaaac aaaataacta gtataaatc
```

FIG. 23 (CONT.)

65161 tgtatcgaat gggaaaaacg aaattatcga cataggtata gaatccggaa cattgaacgt
65221 attaatactt aattcttttt ctgtggtaag taccgatagg ttattgacat tgtatggttt
65281 taaatattct ataacttgag acttgataga tattagtgat gaattgaaaa ttatttttat
65341 caccacgtgt gtttcaggat catcgtcgac gcccgtcaac caaccgaacg gagtaaaata
65401 aatatcatta atatatgctc tagatattag tatttttatc aatcctttga ttatcatctt
65461 ctcgtaggcg aatgattcca tgatcaagag tgatttaaga acatcctccg gagtattaat
65521 gggcttagta aacagtccat cgttgcaata ataaaagtta tccaagttaa aggatattat
65581 gcattcgttt aaagatatca cctcatctga cggagacaat tttttggtag gttttagaga
65641 ctttgaagct acttgtttaa caaagttatt catcgtcgtt tactattcta tttaattttg
65701 tagttaattt atcacatatc acattaattg actttttggt ccatttttcc atacgtttat
65761 attcttttaa tcctgcgtta tccgtttccg ttatatccag tgatagatcg tgcaggttaa
65821 atagaatgct cttaaataat gtcatttttt tatccgctaa aaatttaaag aatgtataaa
65881 ctttttttcaa agatttaaaa cttttaggtg gtgtcctagt acacaatatc ataaacaaac
65941 taataaacat cccgcattca gattccaaca gctgattaac ttccacatta atacagccta
66001 ttttcgctcc aaatgtacat tcgaaaaatc tgaataaaac atcaatgtcg caatttgtat
66061 tatccaatac agaatgtttg tgattcgtgt taaaaccatc ggagaaggaa tagaaataaa
66121 aattattata gtggtggaat tcagttggaa tattgcctcc ggagtcataa aaggatacta
66181 aacattgttt tttatcataa attacacatt tccaatgaga caaataacaa aatccaaaca
66241 ttacaaatct agaggtagaa cttttaattt tgtctttaag tatatacgat aagatatgtt
66301 tattcataaa cgcgtcaaat ttttcatgaa tcgctaagga gtttaagaat ctcatgtcaa

FIG. 23 (CONT.)

66361 attgtcctat ataatccact tcggatccat aagcaaactg agagactaag ttcttaatac
66421 ttcgattgct catccaggct cctctctcag gctctatttt catcttgacg acctttggat
66481 tttcaccagt atgtattcct ttacgtgata aatcatcgat tttcaaatcc atttgtgaga
66541 agtctatcgc cttagatact ttttcccgta gtcgaggttt aaagaaatac gctaacggta
66601 tactagtagg taactcaaaa acatcatata tagaatggta acgcgtcttt aactcgtcgg
66661 ttaactcttt cttttgatcg agttcgtcgc tactattggg tctgctcagg tgccccgact
66721 ctactagttc caacatcata ccgataggaa tacaagacac tttgccggcg gttgtagatt
66781 tatcatattt ttccactaca tatccgttac aatttgttaa aaatttagat acatctatat
66841 tgctacataa tccagctagt gaatatatat gacataataa attggtaaat cctagttctg
66901 gtattttact aattactaaa tctgtatatc tttccattta tcatggaaaa gaatttacca
66961 gatatcttct tttttccaaa ctgcgttaat gtattctctt acaaatattc acaagatgaa
67021 ttcagtaata tgagtaaaac ggaacgtgat agtttctcat tggccgtgtt tccagttata
67081 aaacatagat ggcataacgc acacgttgta aaacataaag gaatatacaa agttagtaca
67141 gaagcacgtg gaaaaaaagt atctcctcca tcactaggaa aacccgcaca cataaaccta
67201 accgcgaagc aatatatata cagtgaacac acaataagct ttgaatgtta tagttttcta
67261 aaatgtataa caaatacaga aatcaattcg ttcgatgagt atatattaag aggactatta
67321 gaagctggta atagtttaca gatattttcc aattccgtag gtaaacgaac agatactata
67381 ggtgtactag ggaataagta tccatttagc aaaattccat tggcctcatt aactcctaaa
67441 gcacaacgag agatattttc agcgtggatt tctcatagac ctgtagtttt aactggagga
67501 actggagtgg gtaagacgtc acaggtaccc aagttattgc tttggtttaa ttatttattt
67561 ggtggattct ctactctaga taaaatcact aactttcacg aaagaccagt cattctatct

FIG. 23 (CONT.)

```
67621 cttcctagga tagctttagt tagattgcat agcaatacca ttttaaaatc attgggattt
67681 aaggtactag atggatctcc tatttcttta cggtacggat ctataccgga agaattaata
67741 aacaaacaac caaaaaaata tggaattgta ttttctaccc ataagttatc tctaacaaaa
67801 ctatttagtt atggcactct tattatagac gaagttcatg agcatgatca aataggagat
67861 attattatag cagtagcgag aaagcatcat acgaaaatag attctatgtt tttaatgact
67921 gccacgttag aggatgaccg agaacggcta aaagtatttt tacctaatcc cgcatttata
67981 catattcctg gagatacact gtttaaaatt agcgaggtat ttattcataa taagataaat
68041 ccatcttcca gaatggcata catagaagaa gaaaagagaa atttagttac tgctatacag
68101 atgtatactc ctcctgatgg atcatccggt atagtctttg tggcatccgt tgcacagtgt
68161 cacgaatata aatcatattt agaaaaaaga ttaccgtatg atatgtatat tattcatggt
68221 aaggtcttag atatagacga aatattagaa aaagtgtatt catcacctaa tgtatcgata
68281 attatttcta ctccttattt ggaatccagc gttactatac gcaatgttac acacatttat
68341 gatatgggta aagtttttgt ccccgctcct tttggaggat cgcaagaatt tatttctaaa
68401 tctatgagag atcaacgaaa aggaagagta ggaagagtta atcctggtac atacgtctat
68461 ttctatgatc tgtcttatat gaagtctata cagcgaatag attcagaatt tctacataat
68521 tatatattgt acgctaataa gtttaatcta acactccccg aagatttgtt tataatccct
68581 acaaatttgg atattctatg gcgtacaaag gaatatatag actcgttcga tattagtaca
68641 gaaacatgga ataaattatt atccaattat tatatgaaga tgatagagta tgctaaactt
68701 tatgtactaa gtcctattct cgctgaggag ttggataact ttgagaggac gggagaatta
68761 actagtattg tacgagaagc cattttatct ctaaatttac gaattaagat tttaaatttt
```

FIG. 23 (CONT.)

```
68821 aaacataaag atgatgatac gtatatacac ttttgtaaaa tattattcgg tgtctataac
68881 ggaacaaacg ctactatata ttatcataga cctctaacgg gatatatgaa tatgatttca
68941 gatactatat ttgttcctgt agataataac taaaaatcaa actctaatga ccacatcttt
69001 ttttagagat gaaaaatttt ctacatctcc ttttgtagac acgactaaac attttgcaaa
69061 aaaaagttta ttagtgttta gataatcgta tacttcatca gtgtagatag taaatgtgaa
69121 caaataaaag gtattcttac tcaatagatt ggtaaattcc atagaatata ttaatccttt
69181 cttcttgaga tcccacatca tttcaaccag agacgtttta tccaatgatt tacctcgtac
69241 tataccacat acaaaactag attttgcagt gacgtcgtac ctggtattcc taccaaacaa
69301 aattttactt ttagttcttt tagaaaattc taaggtagaa tctctatttg ccaatatgtc
69361 atctatggaa ttaccactag caaaaaatga tagaaatata tattgataca tcgcagctgg
69421 ttttgatcta ctatacttta aaaacgaatc agattccata attgcctgta tatcatcagc
69481 tgaaaaacta tgttttacac gtattccttc ggcatttctt tttaatgata tatcttgttt
69541 agacaatgat aaagttatca tgtccatgag agacgcgtct ccgtatcgta taaatatttc
69601 attagatgtt agacgcttca ttaggggtat acttctataa ggtttcttaa tcagtccatc
69661 attggttgcg tcaagaacta ctatcggatg ttgttgggta tctctagtgt tacacatggc
69721 cttactaaag tttgggtaaa taactatgat atctctatta attatagatg catatatttc
69781 attcgtcaag gatattagta tcgacttgct atcgtcatta atacgtgtaa tgtaatcata
69841 taaatcatgc gatagccaag gaaaattcaa atagatgttc atcatataat cgtcgctata
69901 attcatatta atacgttgac attgactaat ttgtaatata gcctcgccac gaagaaagct
69961 ctcgtattca gtttcatcga taaaggatac cgttaaatat aactggttgc cgatagtctc
```

FIG. 23 (CONT.)

```
70021 atagtctatt aagtggtaag tttcgtacaa atacagaatc cctaaaatat tatctaatgt
70081 tggattaatc tttaccataa ctgtataaaa tggagacgga gtcataacta ttttaccgtt
70141 tgtacttact ggaatagacg aaggaataat ctccggacat gctggtaaag acccaaatgt
70201 ctgtttgaag aaatccaatg ttccaggtcc taatctctta acaaaaatta cgatattcga
70261 tcccgatatc ctttgcattc tatttaccag catatcacga actatattaa gattatctat
70321 catgtctatt ctcccaccgt tatataaatc gcctccgcta agaaacgtta gtatatccat
70381 acaatggaat acttcatttc taaaatagta ttcgttttct aattctttaa tgtgaaatcg
70441 tatactagaa agggaaaaat tatctttgag ttttccgtta gaaaagaacc acgaaactaa
70501 tgttctgatt gcgtccgatt ccgttgctga attaatggat ttacaccaaa aactcatata
70561 acttctagat gtagaagcat tcgctaaaaa attagtagaa tcaaaggata taagtagatg
70621 ttccaacaag tgagcaattc ccaagatttc atctatatca ttctcgaatc cgaaattaga
70681 aattcccaag tagatatcct ttttcatccg atcgttgatg aaaatacgaa ctttattcgg
70741 taagacaatc atttactaag gagtaaaata ggaagtaatg ttcgtatgtc gttatcatcg
70801 tataaattaa aggtgtgttt tttaccatta agtgacatta taattttacc aatattggaa
70861 ttataatata ggtgtatttg cgcactcgcg acggttgatg catcggtaaa tatagctgta
70921 tctaatgttc tagtcggtat ttcatcattt cgctgtctaa taatagcgtt ttctctatct
70981 gtttccatta cagctgcctg aagtttattg gtcggataat atgtaaaata ataagaaata
71041 catacgaata acaaaaataa aataagatat aataaagatg ccatttagag atctaatttt
71101 gttcaacttg tccaaattcc tacttacaga agatgaggaa tcgttggaga tagtgtcttc
71161 cttatgtaga ggatttgaaa tatcttatga tgacttgata acttactttc cagataggaa
71221 ataccataaa tatatttcta aagtatttga acatgtagat ttatcggagg aattaagtat
```

FIG. 23 (CONT.)

```
71281 ggaattccat gatacaactt tgcgagattt agtctatctt agattgtaca agtattccaa
71341 gtgtatacgg ccgtgttata aattaggaga taatctaaaa ggcatagttg ttataaagga
71401 caggaatatt tatattaggg aagcaaatga tgacttgata gaatatctcc tcaaggaata
71461 cactcctcag atttatacat attctaatga gcgcgtcccc ataactggtt caaaattaat
71521 tctttgtgga ttttctcaag ttacatttat ggcgtataca acgtcgcata taacaacaaa
71581 taaaaaggta gatgttctcg tttccaaaaa atgtatagat gaactagtcg atccaataaa
71641 ttatcaaata cttcaaaatt tatttgataa aggaagcgga acaataaaca aaatactcag
71701 gaagatattt tattcggtaa caggtggcca aactccatag gtagcttttt ctatttcgga
71761 ttttagaatt tccaaattca ccagcgattt atctgttttg gtgaaatcca aggatttatt
71821 aatgtccaca aatgccattt gttttgtctg tggattgtat ttgaaaatgg aaacgatgta
71881 gttagataga tgcgctgcga agtttcctat tagggttccg cgcttcacgt cacccagcat
71941 acttgaatca ccatccttta aaaaaaatga taagatatca acatggagta tatcatactc
72001 ggattttaat tcttctactg catcactgac attttcacaa atactacaat acggtttacc
72061 gaaaataatc agtacgttct tcatttatgg gtatcaaaaa cttaaaatcg ttactgctgg
72121 aaaataaatc actgacgata ttagatgata atttatacaa agtatacaat ggaatatttg
72181 tggatacaat gagtatttat atagccgtcg ccaattgtgt cagaaactta gaagagttaa
72241 ctacggtatt cataaaatac gtaaacggat gggtaaaaaa gggagggcat gtaacccttt
72301 ttatcgatag aggaagtata aaaattaaac aagacgttag agacaagaga cgtaaatatt
72361 ctaaattaac caaggacaga aaaatgctag aattagaaaa gtgtacatcc gaaatacaaa
72421 atgttaccgg atttatggaa gaagaaataa aggcagaaat gcaattaaaa atcgataaac
```

FIG. 23 (CONT.)

72481 tcacatttca aatatattta tctgattctg ataacataaa aatatcattg aatgagatac
72541 taacacattt caacaataat gagaatgtta cattatttta ttgtgatgaa cgagacgcag
72601 aattcgttat gtgtctcgag gctaaaacac atttctctac cacaggagaa tggccgttga
72661 taataagtac cgatcaggat actatgctat ttgcatctgc tgataatcat cctaagatga
72721 taaaaaactt aactcaactg tttaaatatg ttccatctgc agaggataac tatttagcaa
72781 aattaacggc gttagtgaat ggatgtgatt tctttcctgg actctatggg gcatctataa
72841 cacccaacaa cttaaacaaa atacaattgt ttagtgattt tacaatcgat aatatagtca
72901 ctagtttggc aattaaaaat tattatagaa agactaactc taccgtagac gtgcgtaata
72961 ttgttacgtt tataaacgat tacgctaatt tagacgatgt ctactcgtat attcctcctt
73021 gtcaatgcac tgttcaagaa tttatatttt ccgcattaga tgaaaaatgg aatgaattta
73081 aatcatctta tttagaaagc gtgccgttac cctgccaatt aatgtatgcg ttagaaccac
73141 gcaaggagat tgatgtttca gaagttaaaa ctttatcatc ttatatagat ttcgaaaata
73201 ctaaatcaga tatcgatgtt ataaaatcta tatcctcgat cttcggatat tctaacgaaa
73261 actgtaacac gatagtattc ggcatctata aggataattt actactgagt ataaatagtt
73321 cattttactt taacgatagt ctgttaataa ccaatactaa aagtgataat ataataaata
73381 taggttacta gattaaaaat ggtgttccaa ctcgtgtgct ctacgtgcgg caaagatatt
73441 tctcacgaac gatataaatt gattatacga aaaaaatcat taaaggatgt actcgtcagt
73501 gtaaagaacg aatgttgtag gttaaaatta tctacacaaa tagaacctca acgtaactta
73561 acagtgcaac ctctattgga tataaactaa tatggatccg gttaatttta tcaagacata
73621 tgcgcctaga ggttctatta tttttattaa ttataccatg tcattaacaa gtcatttgaa

FIG. 23 (CONT.)

73681 tccatcgata gaaaaacatg tgggtattta ttatggtacg ttattatcgg aacacttggt
73741 agttgaatca acatatagaa aaggagttcg aatagtccca ttggatagtt tttttgaagg
73801 atatcttagt gcaaaagtat acatgttaga gaatattcaa gttatgaaaa tagcagctga
73861 tacgtcatta actttattgg gtattccgta tggatttggt catgatagaa tgtattgttt
73921 taaattggta gctgactgtt ataaaaatgc cggtattgat acatcgtcta aacgaatatt
73981 aggtaaagat atttttctga gccaaaactt cacagacgat aatagatgga taaagatata
74041 tgattctaat aatttaacat tttggcaaat tgattacctt aaagggtgag ttaatatgca
74101 taactactcc tccgttgttt tttccctcgt tctttttctt aacgttgttt gccatcactc
74161 tcataatgta aagatattct aaaatggtaa acttttgcat atcggacgca gaaattggta
74221 taaatgttgt aattgtatta tttcccgtca atggactagt cacagctcca tcagttttat
74281 atcctttaga gtatttctca ctcgtgtcta acattctaga gcattccatg atctgtttat
74341 cgttgatatt ggccggaaag atagattttt tatttttat tatattacta ttggcaattg
74401 tagatataac ttctggtaaa tatttttcta ccttttcaat ctcttctatt ttcaagccgg
74461 ctatatattc tgctatattg ttgctagtat caatacctttt tctggctaag aagtcatatg
74521 tggtattcac tatatcagtt ttaactggta gttccattag cctttccact tctgcagaat
74581 aatcagaaat tggttcttta ccagaaaatc cagctactat aataggctca ccgatgatca
74641 ttggcaaaat cctatattgt accagattaa tgagagcata tttcatttcc aataattctg
74701 ctagttcttg agacattgat ttatttgatg aatctagttg gttctctaga tactctacca
74761 tttctgccgc atacaataac ttgttagata aaatcagggt tatcaaagtg tttagcgtgg
74821 ctagaatagt gggcttgcat gtattaaaga atgcggtagt atgagtaaac cgttttaacg
74881 aattatatag tctccagaaa tctgtggcgt tacatacatg agccgaatga catcgaagat

FIG. 23 (CONT.)

```
74941 tgtccaatat ttttaatagc tgctctttgt ccattatttc tatatttgac tcgcaacaat
75001 tgtagatacc attaatcacc gattcctttt tcgatgccgg acaatagcac aattgtttag
75061 ctttggactc tatgtattca gaattaatag atatatctct taatacagat tgcactatac
75121 attttgaaac tatgtcaaaa attgtagaac gacgctgttc tgcagccatt taactttaaa
75181 taatttacaa aaatttaaaa tgagcatccg tataaaaatc gataaactgc gccaaattgt
75241 ggcatatttt tcagagttca gtgaagaagt atctataaat gtagactcga cggatgagtt
75301 aatgtatatt tttgccgcct tgggcggatc tgtaaacatt tgggccatta tacctctcag
75361 tgcatcagtg ttctaccgcg gagccgaaaa tattgtgttt aatcttcctg tgtccaaggt
75421 aaaatcgtgt ttgtgtagtt ttcacaatga tgccatcata gatatagaac ctgatctgga
75481 aaataatcta gtaaaacttt ctagttatca tgtagtaagt gtcgattgta ataaggaact
75541 gatgcctatt aggacagata ctactatttg tctaagtata gatcaaaaga aatcttacgt
75601 gtttaatttt cacaagtatg aagaaaaatg ttgtggtaga accgtcattc atttagaatg
75661 gttgttgggc tttatcaagt gtattagtca gcatcagcat ttggctatta tgtttaaaga
75721 tgacaatatt attatgaaga ctcctggtaa tactgatgca ttttccaggg aatattctat
75781 gactgaatgt tctcaagaac tacaaaagtt ttctttcaaa atagctatct cgtctctcaa
75841 caaactacga ggattcaaaa agagagtcaa tgtttttgaa actagaatcg taatggataa
75901 tgacgataac attttaggaa tgttgttttc ggatagagtt caatccttta agatcaacat
75961 ctttatggcg tttttagatt aatactttca atgagataaa tatgggtggc ggagtaagtg
76021 ttgagctccc taaacgggat ccgcctccgg gagtacccac tgatgagatg ttattaaacg
76081 tggataaaat gcatgacgtg atagctcccg ctaagctttt agaatatgtg catataggac
```

FIG. 23 (CONT.)

```
76141 cactagcaaa agataaagag gataaagtaa agaaaagata tccagagttt agattagtca
76201 acacaggacc cggtggtctt tcggcattgt taagacaatc gtataatgga accgcaccca
76261 attgctgtcg cacttttaat cgtactcatt attggaagaa ggatggaaag atatcagata
76321 agtatgaaga gggtgcagta ttagaatcgt gttggccaga cgttcacgac accggaaaat
76381 gcgatgttga tttattcgac tggtgtcagg gggatacgtt cgatagaaac atatgccatc
76441 agtggatcgg ttcagccttt aataggagta atagaactgt agagggtcaa caatcgttaa
76501 taaatctgta taataagatg caaacattat gtagtaaaga tgctagtgta ccaatatgtg
76561 aatcattttt gcatcattta cgcgcacaca atacagaaga tagcaaagag atgatcgatt
76621 atattctaag acaacagtct gcggacttta aacagaaata tatgagatgt agttatccca
76681 ctagagataa gttagaagag tcattaaaat atgcggaacc tcgagaatgt tgggatccag
76741 agtgttcgaa tgccaatgtt aatttcttgc taacacgtaa ttataataat ttaggacttt
76801 gcaatattgt acgatgtaat actagcgtga acaacttaca gatggataaa acttcctcat
76861 taagattgtc atgtggatta agcaatagtg atagattttc tactgttccc gtcaatagag
76921 caaaagtagt tcaacataat attaaacact cgttcgacct aaaattgcat ttgatcagtt
76981 tattatctct cttggtaata tggatactaa ttgtagctat ttaaatgggt gccgcggcaa
77041 gcatacagac gacggtgaat acactcagcg aacgtatctc gtctaaatta gaacaagaag
77101 cgaatgctag tgctcaaaca aaatgtgata tagaaatcgg aaatttttat atccgacaaa
77161 accatggatg taacctcact gttaaaaata tgtgctctgc ggacgcggat gctcagttgg
77221 atgctgtgtt atcagccgct acagaaacat atagtggatt aacaccggaa caaaaagcat
77281 acgtgccagc tatgtttact gctgcgttaa acattcagac gagtgtaaac actgttgtta
```

FIG. 23 (CONT.)

77341 gagattttga aaattatgtg aaacagactt gtaattctag cgcggtcgtc gataacaaat
77401 taaagataca aaacgtaatc atagatgaat gttacggagc cccaggatct ccaacaaatt
77461 tggaatttat taatacagga tctagcaaag gaaattgtgc cattaaggcg ttgatgcaat
77521 tgacgactaa ggccactact caaatagcac ctaaacaagt tgctggtaca ggagttcagt
77581 tttatatgat tgttatcggt gttataatat tggcagcgtt gtttatgtac tatgccaagc
77641 gtatgttgtt cacatccacc aatgataaaa tcaaacttat tttagccaat aaggaaaacg
77701 tccattggac tacttacatg gacacattct ttagaacttc tccgatggtt attgctacca
77761 cggatatgca aaactgaaaa tatattgata atattttaat agattaacat ggaagttatc
77821 actgatcgtc tagacgatat agtgaaacaa aatatagcgg atgaaaaatt tgtagatttt
77881 gttatacacg gtctagagca tcaatgtcct gctatacttc gaccattaat taggttgttt
77941 attgatatac tattatttgt tatagtaatt tatattttta cggtacgtct agtaagtaga
78001 aattatcaaa tgttgttggc gttggtggcg ctagtcatca cattaactat tttttattac
78061 tttatactat aatagtacta gactgacttc taacaaacat ctcacctgcc ataaataaat
78121 gcttgatatt aaagtcttct atttctaaca ctattccatc tgtggaaaat aatactctga
78181 cattatcgct aattgacaca tcggtgagtg atatgcctat aaagtaataa tcttctttgg
78241 gcacatatac cagtgtacca ggttctaaca acctatttac tggtgctcct atagcatact
78301 ttttctttac cttgagaata tccatcgttt gcttggtcaa tagcgatatg tgatttttta
78361 tcaaccactc gaaaaagtaa ttggagtgtt catatcctct acgggctatt gtctcatggc
78421 cgtgtatgaa atttaagtaa cacgactgtg gtagatttgt tctatagagc cggttgccgc
78481 aaatagatag aactaccaat atgtctgtac aaatgttaaa cattaattga ttaacagaaa
78541 aaacaatgtt cgttctggga atagaaacca gatcaaaaca aaattcgtta gaatatatgc

FIG. 23 (CONT.)

78601 cacgtttata cattgaatat aaaataacta cagtttgaaa aataacagta tcatttaaac
78661 atttaacttg cggggttaat ctcacaactt tactgttttt gaactgttca aaatatagca
78721 tagatccgtg agaaatacgt ttagccgcct ttaatagagg aaatcccacc gcctttctgg
78781 atctcaccaa cgacgatagt tctgaccagc aactcatttc ttcatcatcc acctgtttta
78841 acatataata ggcaggagat agatatccgt cattgcaata ttccttctcg taggcacaca
78901 atctaatatt gataaaatct ccattctctt ctctgcattt attatcttgt ttcggtggct
78961 gattaggctg tagtcttggt ttaggctttg gtatatcgtt gttgaatcta ttttggtcat
79021 taaatctttc atttcttcct ggtatatttt tatcacctcg tttggttgga tttttgtcta
79081 tattatcgtt tgtaacatcg gtacgggtat tcatttatca caaaaaaaac ttctctaaat
79141 gagtctactg ctagaaaacc tcatcgaaga agataccata tttttgcag gaagtatatc
79201 tgagtatgat gatttacaaa tggttattgc cggcgcaaaa tccaaatttc caagatctat
79261 gctttctatt tttaatatag tacctagaac gatgtcaaaa tatgagttgg agttgattca
79321 taacgaaaat atcacaggag caatgtttac cacaatgtat aatataagaa acaatttggg
79381 tctaggagat gataaactaa ctattgaagc cattgaaaac tatttcttgg atcctaacaa
79441 tgaagttatg cctcttatta ttaataatac ggatatgact gccgtcattc ctaaaaaaag
79501 tggtaggaga aagaataaga acatggttat cttccgtcaa ggatcatcac ctatcttgtg
79561 tattttcgaa actcgtaaaa agattaatat ttataaagaa aatatggaat ccgcgtcgac
79621 tgagtataca cctatcggag acaacaaggc tttgatatct aaatatgcgg gaattaatat
79681 cctaaatgtg tattctcctt ccacatccat aagattgaat gccatttacg gattcaccaa
79741 taaaaataaa ctagagaaac ttagtactaa taaggaacta gaatcgtata gttctagccc

FIG. 23 (CONT.)

```
79801 tcttcaagaa cccattaggt taaatgattt tctgggacta ttggaatgtg ttaaaaagaa
79861 tattcctcta acagatattc cgacaaagga ttgattacta taaatggaga atgttcctaa
79921 tgtatacttt aatcctgtgt ttatagagcc cacgtttaaa cattctttat taagtgttta
79981 taaacacaga ttaatagttt tatttgaagt attcgttgta ttcattctaa tatatgtatt
80041 ttttagatct gaattaaata tgttcttcat gcctaaacga aaaatacccg atcctattga
80101 tagattacga cgtgctaatc tagcgtgtga agacgataaa ttaatgatct atggattacc
80161 atggatgaca actcaaacat ctgcgttatc aataaatagt aaaccgatag tgtataaaga
80221 ttgtgcaaag cttttgcgat caataaatgg atcacaacca gtatctctta acgatgttct
80281 tcgcagatga tgattcattt tttaagtatt tggctagtca agatgatgaa tcttcattat
80341 ctgatatatt gcaaatcact caatatctag actttctgtt attattattg atccaatcaa
80401 aaaataaatt agaagccgtg ggtcattgtt atgaatctct ttcagaggaa tacagacaat
80461 tgacaaaatt cacagacttt caagatttta aaaaactgtt taacaaggtc cctattgtta
80521 cagatggaag ggtcaaactt aataaaggat atttgttcga ctttgtgatt agtttgatgc
80581 gattcaaaaa agaatcctct ctagctacca ccgcaataga tcctgttaga tacatagatc
80641 ctcgtcgcaa tatcgcattt tctaacgtga tggatatatt aaagtcgaat aaagtgaaca
80701 ataattaatt ctttattgtc atcatgaacg gcggacatat tcagttgata atcggcccca
80761 tgttttcagg taaaagtaca gaattaatta gacgagttag acgttatcaa atagctcaat
80821 ataaatgcgt gactataaaa tattctaacg ataatagata cggaacggga ctatggacgc
80881 atgataagaa taattttgaa gcattggaag caactaaact atgtgatgtc ttggaatcaa
80941 ttacagattt ctccgtgata ggtatcgatg aaggacagtt ctttccagac attgttgaat
```

FIG. 23 (CONT.)

```
81001 tctgtgagcg tatggcaaac gaaggaaaaa tagttatagt agccgcactc gatgggacat
81061 ttcaacgtaa accgtttaat aatattttga atcttattcc attatctgaa atggtggtaa
81121 aactaactgc tgtgtgtatg aaatgcttta aggaggcttc cttttctaaa cgattgggtg
81181 aggaaaccga gatagaaata ataggaggta atgatatgta tcaatcggtg tgtagaaagt
81241 gttacatcga ctcataatat tatatttttt atctaaaaaa ctaaaaataa acattgatta
81301 aattttaata taatacttaa aaatggatgt tgtgtcgtta gataaaccgt ttatgtattt
81361 tgaggaaatt gataatgagt tagattacga accagaaagt gcaaatgagg tcgcaaaaaa
81421 actgccgtat caaggacagt taaaactatt actaggagaa ttattttttc ttagtaagtt
81481 acagcgacac ggtatattag atggtgccac cgtagtgtat ataggatctg ctcccggtac
81541 acatatacgt tatttgagag atcatttcta taatttagga gtgatcatca aatggatgct
81601 aattgacggc cgccatcatg atcctatttt aaatggattg cgtgatgtga ctctagtgac
81661 tcggttcgtt gatgaggaat atctacgatc catcaaaaaa caactgcatc cttctaagat
81721 tattttaatt tctgatgtga gatccaaacg aggaggaaat gaacctagta cggcggattt
81781 actaagtaat tacgctctac aaaatgtcat gattagtatt ttaaaccccg tggcgtctag
81841 tcttaaatgg agatgcccgt ttccagatca atggatcaag gacttttata tcccacacgg
81901 taataaaatg ttacaacctt ttgctccttc atattcagct gaaatgagat tattaagtat
81961 ttataccggt gagaacatga gactgactcg agttaccaaa tcagacgctg taaattatga
82021 aaaaaagatg tactacctta ataagatcgt ccgtaacaaa gtagttgtta actttgatta
82081 tcctaatcag gaatatgact attttcacat gtactttatg ctgaggaccg tgtactgcaa
82141 taaaacattt cctactacta aagcaaaggt actatttcta caacaatcta tatttcgttt
82201 cttaaatatt ccaacaacat caactgaaaa agttagtcat gaaccaatac aacgtaaaat
```

FIG. 23 (CONT.)

82261 atctagcaaa aattctatgt ctaaaaacag aaatagcaag agatccgtac gcagtaataa
82321 atagaaacgt actactgaga tatactaccg atatagagta taatgattta gttactttaa
82381 taaccgttag acataaaatt gattctatga aaactgtgtt tcaggtattt aacgaatcat
82441 ccataaatta tactccggtt gatgatgatt atggagaacc aatcattata acatcgtatc
82501 ttcaaaaagg tcataacaag tttcctgtaa attttctata catagatgtg gtaatatctg
82561 acttatttcc tagctttgtt agactagata ctacagaaac taatatagtt aatagtgtac
82621 tacaaacagg cgatggtaaa aagactcttc gtcttcccaa aatgttagag acggaaatag
82681 ttgtcaagat tctctatcgc cctaatatac cattaaaaat tgttagattt ttccgcaata
82741 acatggtaac tggagtagag atagccgata gatctgttat ttcagtcgct gattaatcaa
82801 ttagtagaga tgagataaga acattataat aatcaataat atatcttata tctcgtttag
82861 aaaaatgcta atattaaaat agctaacgct agtaatccaa tcggaagcca tttgatatct
82921 ataatagggt atctaatttc ctgattcaga tagcggacag ctatattctc ggtagctact
82981 cgtttggaat cacaaacatt atttacatct aatttactat ctgtaatgga aacgtttccc
83041 aatgaaatgg tacaatccga tacattgcat tttgttatat tttttttaa agaggctggt
83101 aacaacgcat cgcttcgttt acatggctcg taccaacaat aatagggtaa tcttgtatct
83161 attcctatcc gtactatgct tttatcagga taaatacatt tacatcgtat atcgtctttg
83221 ttagcatcac agaatgcata aatttgttcg tccgtcatga taaaaattta aagtgtaaat
83281 ataactatta tttttatagt tgtaataaaa agggaaattt gattgtatac cttcggttct
83341 ttaaaagaaa ctgacttgat aaaaatggct gtaatctcta aggttacgta tagtctatat
83401 gatcaaaaag agattaatgc tacagatatt atcattagtc atgttaaaaa tgacgacgat

FIG. 23 (CONT.)

83461 atcggtaccg ttaaagatgg tagactaggt gctatggatg gggcattatg taagacttgt
83521 gggaaaacgg aattggaatg tttcggtcac tggggtaaag taagtattta taaaactcat
83581 atagttaagc ctgaatttat ttcagaaatt attcgtttac tgaatcatat atgtattcac
83641 tgcggattat tgcgttcacg agaaccgtat tccgacgata ttaacctaaa agagttatcg
83701 ggacacgctc ttaggagatt aaaggataaa atattatcca agaaaaagtc atgttggaac
83761 agtgaatgta tgcaaccgta tcaaaaaatt actttttcaa agaaaaaggt ttgtttcgtc
83821 aacaagttgg atgatattaa cgttcctaat tctctcatct atcaaaagtt aatttctatt
83881 catgaaaagt tttggccatt attagaaatt catcaatatc cagctaactt attttataca
83941 gactactttc ccatccctcc gttgattatt agaccggcta ttagtttttg gatagatagt
84001 atacccaaag aaaccaatga attaacttac ttattaggta tgatcgttaa gaattgtaac
84061 ttgaatgctg atgaacaggt tatccagaag gcggtaatag aatacgatga tattaaaatt
84121 atttctaata acacttccag tatcaattta tcatatatta catccggcaa aaataatatg
84181 attagaagtt atatcgtcgc ccgacgaaaa gatcagacgg ctagatctgt aattggtccc
84241 agtacatcta tcaccgttaa tgaggtagga atgcccgcat atattagaaa tacacttaca
84301 gaaaagatat ttgttaatgc ctttacagtg gataaagtta aacaactatt agcatcaaac
84361 caagttaaat tttactttaa taaacgatta aaccaattaa caagaatacg ccaaggaaag
84421 tttatcaaaa ataaaataca tttattgcct ggtgattggg tagaagtagc tgttcaagaa
84481 tatacaagta ttatttttgg aagacagccg tctctacata gatacaacgt catcgcttca
84541 tctatcagag ctaccgaagg agatactatc aaaatatctc ccggaattgc caactctcaa
84601 aatgctgatt tcgacggaga tgaagaatgg atgatattag aacaaaatcc taaagctgta

FIG. 23 (CONT.)

84661 attgaacaaa gtattcttat gtatccgacg acgttactca aacacgatat tcatggagcc
84721 cccgtttatg gatctattca agatgaaatc gtagcagcgt attcattgtt taggatacaa
84781 gatctttgtt tagatgaagt attgaacatc ttggggaaat atggaagaga gttcgatcct
84841 aaaggtaaat gtaaattcag cggtaaagat atctatactt acttgatagg tgaaaagatt
84901 aattatccgg gtctcttaaa ggatggtgaa attattgcaa acgacgtaga tagtaatttt
84961 gttgtggcta tgaggcatct gtcattggct ggactcttat ccgatcataa gtcgaacgtg
85021 gaaggtatca actttattat caagtcatct tatgttttta agagatatct atctatttac
85081 ggttttgggg tgacattcaa agatctgaga ccaaattcga cgttcactaa taaattggag
85141 gccatcaacg tagaaaaaat agaacttatc aaagaagcat acgccaaata tctcaacgat
85201 gtaagagacg ggaaaatagt tccattatct aaagctttag aggcggacta tgtggaatcc
85261 atgttatcca acttgacaaa tcttaatatc cgagagatag aagaacatat gagacaaacg
85321 ctgatagatg atccagataa taacctcctg aaaatggcca aagcgggtta taaagtaaat
85381 cctacagaac taatgtatat tctaggtacg tatggacaac aaaggattga tggtgaacca
85441 gcagagactc gagtattggg tagagtctta ccttactatc ttccagactc taaggatcca
85501 gaaggaagag gttacattct taattcttta acaaaaggat taacaggttc tcaatattac
85561 ttttcgatgc tggttgcaag atctcaatct actgatatcg tctgtgaaac atcacgtacc
85621 ggaacactgg ctagaaaaat cattaaaaag atggaggata tggtggtcga cggatacgga
85681 caagtagtta taggtaatac gctcatcaag tacgccgcca attataccaa aattctaggc
85741 tcagtatgta aacctgtaga tcttatctat ccagatgagt ccatgacttg gtatttggaa
85801 attagtgctc tgtggaataa aataaaacag ggattcgttt actctcagaa acagaaactt
85861 gcaaagaaga cattggcgcc gtttaatttc ctagtattcg tcaaacccac cactgaggat

FIG. 23 (CONT.)

```
85921 aatgctatta aggttaagga tctgtacgat atgattcata acgtcattga tgatgtgaga
85981 gagaaatact tctttacggt atctaatata gattttatgg agtatatatt cttgacgcat
86041 cttaatcctt ctagaattag aattacaaaa gaaacggcta tcactatctt tgaaaagttc
86101 tatgaaaaac tcaattatac tctaggtggt ggaactccta ttggaattat ttctgcacag
86161 gtattgtctg agaagtttac acaacaagcc ctgtccagtt ttcacactac tgaaaaaagt
86221 ggtgccgtca aacaaaaact tggtttcaac gagtttaata acttgactaa tttgagtaag
86281 aataagaccg aaattatcac tctggtatcc gatgatatct ctaaacttca atctgttaag
86341 attaatttcg aatttgtatg tttgggagaa ttaaatccag acatcactct tcgaaaagaa
86401 acagataggt atgtagtaga tataatagtc aatagattat acatcaagag agcagaaatt
86461 accgaattag tcgtcgaata tatgattgaa cgattcatct cctttagcgt cattgtaaag
86521 gaatggggta tggaaacatt cattgaggac gaggataata ttagatttac tgtctatcta
86581 aatttcgttg aaccagagga attgaatctt agtaagttta tgatggttct tccgggggca
86641 gccaacaagg gaaagattag taaattcaag attcctatct ctgattatac gggttatgac
86701 gacttcaatc aaacaaaaaa gctcaataag atgactgtag aactcatgaa tctaaaagaa
86761 ttaggttctt tcgatttgga aaacgtcaac gtgtatcctg gagtatggaa tacatacgat
86821 atcttcggta tcgaggccgc tcgtgaatac ttgtgcgaag ccatgttaaa cacctatgga
86881 gaagggttcg attatctgta tcagccttgt gatcttctcg ctagtttact atgtgctagt
86941 tacgaaccag aatcagtgaa taaattcaag ttcggcgcag ctagtactct taagagagct
87001 acgttcggag acaataaagc attgttaaac gcggctcttc ataaaaagtc agaacctatt
87061 aacgataata gtagctgcca cttttttagc aaggtcccta atataggaac tggatattac
```

FIG. 23 (CONT.)

```
87121 aaatacttta tcgacttggg tcttctcatg agaatggaaa ggaaactatc tgataagata
87181 tcttctcaaa agatcaagga aatggaagaa acagaagact tttaattctt atcaataaca
87241 tatttttcta tgatctgtct tttaaacgat ggattttcca caaatgcgcc tctcaagtcc
87301 ctcatagaat gatacacgta taaaaaatat agcataggca atgactcctt atttttagac
87361 attagatatg ccaaaatcat agccccgctt ctatttactc ccgcagcaca atgaaccaac
87421 acgggctcgt ttcgttgatc acatttagat aaaaaggcgg ttacgtcgtc aaaatattta
87481 ctaatatcgg tagttgtatc atctaccaac ggtatatgaa taatattaat attagagtta
87541 ggtaatgtat atttatccat cgtcaaattt aaaacatatt tgaacttaac ttcagatgat
87601 ggtgcatcca tagcattttt ataatttccc aaatacacat tattggttac ccttgtcatt
87661 atagtgggag atttggctct gtgcatatct ccagttgaac gtagtagtaa gtatttatac
87721 aaacttttct tatccattta taacgtacaa atggataaaa ctactttatc ggtaaacgcg
87781 tgtaatttag aatacgttag agaaaaggct atagtaggcg tacaagcagc caaaacatca
87841 acacttatat tctttgttat tatattggca attagtgcgc tattactctg gtttcagacg
87901 tctgataatc cagtctttaa tgaattaacg agatatatgc gaattaaaaa tacggttaac
87961 gattggaaat cattaacgga tagcaaaaca aaattagaaa gtgatagagg tagacttcta
88021 gccgctggta aggatgatat attcgaattc aaatgtgtgg atttcggcgc ctattttata
88081 gctatgcgat tggataagaa aacatatctg ccgcaagcta ttaggcgagg tactggagac
88141 gcgtggatgg ttaaaaaggc ggcaaaggtc gatccatctg ctcaacaatt ttgtcagtat
88201 ttgataaaac acaagtctaa taatgttatt acttgtggta atgagatgtt aaatgaatta
88261 ggttatagcg gttattttat gtcaccgcat tggtgttccg attttagtaa tatggaatag
```

FIG. 23 (CONT.)

```
88321 tgttagataa atgcggtaac gaatgttcct gtaaggaacc ataacagttt agatttaacg
88381 ttaaagatga gcataaacat aataaacaaa attacaatca aacctataac attaatatca
88441 aacaatccaa aaaatgaaat cagtggagta gtaaacgcgt acataactcc tggataacgt
88501 ttagtagctg ccgttcctat tctagaccaa aaattcggtt tcatgttttc gaaacggtgt
88561 tctgcaacaa gtcggggatc gtgttctaca tatttggcgg cattatccag tatctgccta
88621 ttgatcttca tttcgttttc aattctggct atttcaaaat aaaatcccga tgatagacct
88681 ccagacttta taatttcatc tacgatgttc agcgccgtag taactctaat aatataggct
88741 gataagctaa catcataccc tcctgtatat gtgaatatgg catgattttt gtccattaca
88801 agctcggttt taactttatt gcctgtaata atttctctca tctgtaggat atctattttt
88861 ttgtcatgca ttgccttcaa gacgggacga agaaacgtaa tatcctcaat aacgttatcg
88921 ttttctacaa taactacata ttctaccttt ttattttcta actcggtaaa aaaattagaa
88981 tcccataggg ctaaatgtct agcgatattt cttttcgttt cctctgtaca catagtgtta
89041 caaaaccctg aaaagaagtg agtatacttg tcatcatttc taatgtttcc tccagtccac
89101 tgtataaacg cataatcctt gtaatgatct ggatcatcct tgactaccac aacatttctt
89161 ttttctggca taacttcgtt gtcctttaca tcatcgaact tctgatcatt aatatgctca
89221 tgaacattag gaaatgtttc tgatggaagt ctatcaataa ctggcacaac aataacagga
89281 gttttcgccg ccgccattta gttattgaaa ttaatcatat acaactcttt aatacgagtt
89341 atattttcgt ctatccattg tttcacattt acatatttcg acaaaaagat ataaaatgcg
89401 tattccaatg cttctctgtt taatgaatta ctaaaatata caaacacgtc actgtctggc
89461 aataaatgat atcttagaat attgtaacaa tttattttgt attgcacatg ttcgtgatct
89521 atgagttctt cttcgaatgg cataggatct ccgaatctga aaacgtataa ataggagtta
```

FIG. 23 (CONT.)

89581 gaataataat atttgagagt attggtaata tataaactct ttagcggtat aattagtttt
89641 tttctctcaa tttctatttt tagatgtgat ggaaaaatga ctaattttgt agcattagta
89701 tcatgaactc taatcaaaat cttaatatct tcgtcacacg ttagctcttt gaagttttta
89761 agagatgcat cagttggttc gaccgatgga gtaggtgcaa caatttttg ttcgatgtat
89821 gtatgtactg gagccattgt tttaactata atggtgcttg tatcgaaaaa ctttaatgca
89881 gatagcggaa gctcttcgcc gcgactttct acatcgtaat tgggttctaa cgccgatctc
89941 tgaatggata ctagttttct aagttctaat gtgattctct gaaaatgtaa atccaattcc
90001 tccggcatta tagatgtgta tacatcggta aataaaacta tagtatccaa cgatcccttc
90061 tcgcaaattc tagtcttaac caaaaaatcg tatataacca cggagatggc gtatttaaga
90121 gtggattctt ctaccgtttt gttcttggat gtcatatagg aaactataaa gtccgcacta
90181 ctgttaagaa tgattactaa cgcaactata tagttcaaat taagcatttt ggaaacataa
90241 aataactctg tagacgatac ttgactttcg aataagtttg cagacaaacg aagaaagaac
90301 agacctctct taatttcaga agaaaacttt ttttcgtatt cctgacgtct agagtttata
90361 tcaataagaa agttaagaat tagtcggtta atgttgtatt tcattaccca agtttgagat
90421 ttcataatat tatcaaaaga catgataata ttaaagataa agcgctgact atgaacgaaa
90481 tagctatatg gttcgctcaa aaatatagtc ttgttaaacg tggaaacgat aactgtattt
90541 ttaatcacgt cagcggcatc taaattaaat ataggtatat ttattccaca cactctacaa
90601 tatgccacac catcttcata ataaataaat tcgttagcaa aattattaat tttagtgaaa
90661 tagttagcgt caactttcat agcttccttc aatctaattt gatgctcaca cggtgcgaat
90721 tccactctaa catccctttt ccatgcctca ggttcatcga tctctataat atctagtttt

FIG. 23 (CONT.)

90781 ttgcgtttca caaacacagg ctcgtctctc gcgatgagat ctgtatagta actatgtaaa
90841 tgataactag atagaaagat gtagctatat agatgacgat cctttaagag aggtataata
90901 actttacccc aatcagatag actgttgtta tggtcttcgg aaaaagaatt tttataaatt
90961 tttccagtat tttccaaata tacgtactta acatctaaaa aatccttaat gataatagga
91021 atggataatc cgtctatttt ataaagaaat acatatcgca cattatactt ttttttggaa
91081 atgggaatac cgatgtgtct acataaatat gcaaagtcta aatatttttt agagaatctt
91141 aattggtcca aattcttttc caagtacggt aatagatttt tcatattgaa cggtatcttc
91201 ttaatctctg gttctagttc cgcattaaat gatgaaacta agtcactatt tttataacta
91261 acgattacat cacctctaac atcatcattt accagaatac tgatcttctt ttgtcgtaaa
91321 tacatgtcta atgtgttaaa aaaaagatca tacaagttat acgtcatttc atctgtggta
91381 ttcttgtcat tgaaggataa actcgtacta atctcttctt taacagcctg ttcaaattta
91441 tatcctatat acgaaaaaat agcaaccagt gtttgatcat ccgcgtcaat attctgttct
91501 atcgtagtgt ataacaatcg tatatcttct tctgtgatag tcgatacgtt ataaaggttg
91561 ataacgaaaa tatttttatt tcgtgaaata aagtcatcgt aggattttgg acttatattc
91621 gcgtctagta gatatgcttt tatttttgga atgatctcaa ttagaatagt ctctttagag
91681 tccatttaaa gttacaaaca actaggaaat tggtttatga tgtataattt ttttagtttt
91741 tatagattct ttattctata cttaaaaaat gaaaataaat acaaaggttc ttgagggttg
91801 tgttaaattg aaagcgagaa ataatcataa attatttcat tatcgcgata tccgttaagt
91861 ttgtatcgta atggcgtggt caattacaaa taaagcggat actagtagct tcacaaagat
91921 ggctgaaatc agagctcatc taaaaaatag cgctgaaaat aaagataaaa acgaggatat

FIG. 23 (CONT.)

```
91981 tttcccggaa gatgtaataa ttccatctac taagcccaaa accaaacgag ccactactcc
92041 tcgtaaacca gcggctacta aaagatcaac caaaaaggag gaagtggaag aagaagtagt
92101 tatagaggaa tatcatcaaa caactgaaaa aaattctcca tctcctggag tcagcgacat
92161 tgtagaaagc gtggccgctg tagagctcga tgatagcgac ggggatgatg aacctatggt
92221 acaagttgaa gctggtaaag taaatcatag tgctagaagc gatctctctg acctaaaggt
92281 ggctaccgac aatatcgtta aagatcttaa gaaaattatt actagaatct ctgcagtatc
92341 gacggttcta gaggatgttc aagcagctgg tatctctaga caatttactt ctatgactaa
92401 agctattaca acactatctg atctagtcac cgagggaaaa tctaaagttg ttcgtaaaaa
92461 agttaaaact tgtaagaagt aaatgcgtgc acttttttat aaagatggta aactctttac
92521 cgataataat tttttaaatc ctgtatcaga cgataatcca gcgtatgagg ttttgcaaca
92581 tgttaaaatt cctactcatt taacagatgt agtagtatat gaacaaacgt gggaggaggc
92641 gttaactaga ttaatttttg tgggaagtga ttcaaaagga cgtagacaat acttttacgg
92701 aaaaatgcat gtacagaatc gcaacgctaa aagagatcgt atttttgtta gagtatataa
92761 cgttatgaaa cgaattaatt gttttataaa caaaaatata aagaaatcgt ccacagattc
92821 caattatcag ttggcggttt ttatgttaat ggaaactatg tttttttatta gatttggtaa
92881 aatgaaatat cttaaggaga atgaaacagt agggttatta acactaaaaa ataaacacat
92941 agaaataagt cccgatgaaa tagttatcaa gtttgtagga aaggacaaag tttcacatga
93001 atttgttgtt cataagtcta atagactata taagccgcta ttgaaactga cggatgattc
93061 tagtcccgaa gaatttctgt tcaacaaact aagtgaacga aaggtatatg aatgtatcaa
93121 acagtttggt attagaatca aggatctccg aacgtatgga gtcaattata cgtttttata
93181 taatttttgg acaaatgtaa agtccatatc tcctcttcca tcaccaaaaa agttaatagc
```

FIG. 23 (CONT.)

93241 gttaactatc aaacaaactg ctgaagtggt aggtcatact ccatcaattt caaaaagagc
93301 ttatatggca acgactattt tagaaatggt aaaggataaa aatttttag atgtagtatc
93361 taaaactacg ttcgatgaat tcctatctat agtcgtagat cacgttaaat catctacgga
93421 tggatgatat agatctttac acaaataatt acaaaaccga taaatggaaa tggataagcg
93481 tatgaaatct ctcgcaatga ccgctttctt tggggagcta agcacattag atattatggc
93541 attgataatg tctatattta aacgccatcc aaacaatacc atttttcag tggataagga
93601 tggtcagttt atgattgatt tcgaatacga taattataag gcttctcaat atttggatct
93661 gaccctcact ccgatatctg gagatgaatg caagactcac gcatcgagta tagccgaaca
93721 attggcgtgt gtggatatta ttaaagagga tattagcgaa tatatcaaaa ctactccccg
93781 tcttaaacga tttataaaaa aataccgcaa tagatcagat actcgcatca gtcgagatac
93841 agaaaagctt aaaatagctc tagctaaagg catagattac gaatatataa aagacgcttg
93901 ttaataagta aatgaaaaaa aactagtcgt ttataataaa acacgatatg gatgccaacg
93961 tagtatcatc ttctactatt gcgacgtata tagacgcttt agcgaagaat gcttcggaat
94021 tagaacagag gtctaccgca tacgaaataa ataatgaatt ggaactagta tttattaagc
94081 cgccattgat tactttgaca aatgtagtga atatctctac gattcaggaa tcgtttattc
94141 gatttaccgt tactaataag gaaggtgtta aaattagaac taagattcca ttatctaagg
94201 tacatggtct agatgtaaaa aatgtacagt tagtagatgc tatagataac atagtttggg
94261 aaaagaaatc attagtgacg gaaaatcgtc ttcacaaaga atgcttgttg agactatcga
94321 cagaggaacg tcatatattt ttggattaca agaaatatgg atcctctatc cgactagaat
94381 tagtcaatct tattcaagca aaaacaaaaa actttacgat agactttaag ctaaaatatt

FIG. 23 (CONT.)

94441 ttctaggatc cggtgcccag tctaaaagtt ctttattaca cgctattaat catccaaagt
94501 caaggcctaa tacatctctg gaaatagaat ttacacctag agacaatgaa acagttccat
94561 atgatgaact aataaaggaa ttgacgactc tctcgcgtca tatatttatg gcttctccag
94621 agaatgtaat tctttctccg cctattaacg cgcctataaa aacctttatg ttgcctaaac
94681 aagatatagt aggtttggat ctggaaaatc tatatgccgt aactaagact gacggcattc
94741 ctataactat cagagttaca tcaaacgggt tgtattgtta ttttacacat cttggttata
94801 ttattagata tcctgttaag agaataatag attccgaagt agtagtcttt ggtgaggcag
94861 ttaaggataa gaactggacc gtatatctca ttaagctaat agagcctgtg aatgcaatca
94921 atgatagact agaagaaagt aagtatgttg aatctaaact agtggatatt tgtgatcgga
94981 tagtattcaa gtcaaagaaa tacgaaggtc cgtttactac aactagtgaa gtcgtcgata
95041 tgttatctac atatttacca aagcaaccag aaggtgttat tctgttctat tcaaagggac
95101 ctaaatctaa cattgatttt aaaattaaaa aggaaaatac tatagaccaa actgcaaatg
95161 tagtatttag gtacatgtcc agtgaaccaa ttatctttgg agagtcgtct atctttgtag
95221 agtataagaa atttagcaac gataaaggct ttcctaaaga atatggttct ggtaagattg
95281 tgttatataa cggcgttaat tatctaaata atatctattg tttggaatat attaatacac
95341 ataatgaagt gggtattaag tccgtggttg tacctattaa gtttatagca gaattcttag
95401 ttaatggaga aatacttaaa cctagaattg ataaaaccat gaaatatatt aactcagaag
95461 attattatgg aaatcaacat aatatcatag tcgaacattt aagagatcaa agcatcaaaa
95521 taggagatat ctttaacgag gataaactat cggatgtggg acatcaatac gccaataatg
95581 ataaatttag attaaatcca gaagttagtt attttacgaa taaacgaact agaggaccgt

FIG. 23 (CONT.)

```
95641 tgggaatttt atcaaactac gtcaagactc ttcttatttc tatgtattgt tccaaaacat
95701 ttttagacga ttccaacaaa cgaaaggtat tggcgattga ttttggaaac ggtgctgacc
95761 tggaaaaata cttttatgga gagattgcgt tattggtagc gacggatccg gatgctgatg
95821 ctatagctag aggaaatgaa agatacaaca aattaaactc tggaattaaa accaagtact
95881 acaaatttga ctacattcag gaaactattc gatccgatac atttgtctct agtgtcagag
95941 aagtattcta ttttggaaag tttaatatca tcgactggca gtttgctatc cattattctt
96001 ttcatccgag acattatgct accgtcatga ataacttatc cgaactaact gcttctggag
96061 gcaaggtatt aatcactacc atggacggag acaaattatc aaaattaaca gataaaaaga
96121 cttttataat tcataagaat ttacctagta gcgaaaacta tatgtctgta gaaaaaatag
96181 ctgatgatag aatagtggta tataatccat caacaatgtc tactccaatg actgaataca
96241 ttatcaaaaa gaacgatata gtcagagtgt ttaacgaata cggatttgtt cttgtagata
96301 acgttgattt cgctacaatt atagaacgaa gtaaaaagtt tattaatggc gcatctacaa
96361 tggaagatag accatctaca agaaactttt tcgaactaaa tagaggagcc attaaatgtg
96421 aaggtttaga tgtcgaagac ttacttagtt actatgttgt ttatgtcttt tctaagcggt
96481 aaataataat atggtatggg ttctgatctc ccagttctaa atgcattaaa taattccaat
96541 agagcgattt ttgttcctat aggaccttcc aactgtggat actctgtatt gttaatagat
96601 atattaatac ttttgtcggg taacagaggt tctacgtctt ttaaaaataa aagtttgata
96661 acatctggcc tgttcataaa taaaaacttg gcgattctat atatactctt attatcaaat
96721 ctagccattg tcttatagat gtgagctact gtaggtgtac catttgattt tctttctaat
96781 actatatatt tctctcgaag aagttcttgc acatcatctg ggaataaaat actactgttg
96841 agtaaatcag ttattttttt tatatcgata ttgatggaca tttttatagt taaggataat
```

FIG. 23 (CONT.)

```
96901 aagtatccca aagtagataa cgacgataac gaagtattta tacttttagg aaatcacaat
96961 gactttatca gattaaaatt aacaaaatta aaggagcatg tatttttttc tgaatatatt
97021 gtgactccag atacatatgg atctttatgc gtcgaattaa atgggtctag ttttcagcac
97081 ggcggtagat atatagaggt ggaggaattt atagatgctg gaagacaagt tagatggtgt
97141 tctacatcca atcatatatc taaagatata cccgaagata tgcacactga taaatttgtc
97201 atttatgata tatacacttt tgacgctttc aagaataaac gattggtatt cgtacaggta
97261 cctccgtcgt taggagatga tagtcatttg actaatccgt tattgtctcc gtattatcgt
97321 aattcagtag ccagacaaat ggtcaatgat atgattttta atcaagattc atttttaaaa
97381 tatttattag aacatctgat tagaagccac tatagagttt ctaaacatat aacaatagtt
97441 agatacaagg ataccgaaga attaaatcta acgagaatat gttataatag agataagttt
97501 aaggcgtttg tattcgcttg gtttaacggc gtttcggaaa atgaaaaggt actagatacg
97561 tataaaaagg tatctaattt gatataatga attcagtgac tgtatcacac gcgccatata
97621 ctattactta tcacgatgat tgggaaccag taatgagtca attggtagag ttttataacg
97681 aagtagccag ttggctgcta cgagacgaga cgtcgcctat tcctgataag ttctttatac
97741 agttgaaaca accgcttaga aataaacgag tatgtgtgtg cggtatagat ccgtatccga
97801 aagatggaac tggtgtaccg ttcgaatcac caaattttac aaaaaaatca attaaggaga
97861 tagcttcatc tatatctaga ttaaccggag taattgatta taaaggttat aaccttaata
97921 taatagacgg ggttataccc tggaattatt acttaagttg taaattagga gaaacaaaaa
97981 gtcacgcgat ctactgggat aagatttcca agttactgct gcagcatata actaaacacg
98041 ttagtgttct ttattgtttg ggtaaaacag atttctcgaa tatacgggcc aagttagaat
```

FIG. 23 (CONT.)

```
98101 ccccggtaac taccatagtc ggatatcatc cagcggctag agaccgccaa ttcgagaaag
98161 atagatcatt tgaaattatc aacgttttac tggaattaga caacaaggca cctataaatt
98221 gggctcaagg gtttatttat taatgcttta gtgaaatttt aacttgtgtt ctaaatggat
98281 gcggctatta gaggtaatga tgttatcttt gttcttaaga ctataggtgt cccgtcagcg
98341 tgcagacaaa atgaagatcc aagatttgta gaagcattta aatgcgacga gttagaaaga
98401 tatattgaga ataatccaga atgtacacta ttcgaaagtc ttagggatga ggaagcatac
98461 tctatagtca gaattttcat ggatgtagat ttagacgcgt gtctagacga aatagattat
98521 ttaacggcta ttcaagattt tattatcgag gtgtcaaact gtgtagctag attcgcgttt
98581 acagaatgcg gcgccattca tgaaaatgta ataaaatcca tgagatctaa tttttcattg
98641 actaagtcta caaatagaga taaaacaagt tttcatatta tctttttaga cacgtatacc
98701 actatggata cattgatagc tatgaaacga acactattag aattaagtag atcatctgaa
98761 aatccactaa caagatcgat agacactgcc gtatatagga gaaaaacaac tcttcgggtt
98821 gtaggtacta ggaaaaatcc aaattgcgac actattcatg taatgcaacc accgcatgat
98881 aatatagaag attacctatt cacttacgtg gatatgaaca acaatagtta ttacttttct
98941 ctacaacaac gattggagga tttagttcct gataagttat gggaaccagg gtttatttca
99001 ttcgaagacg ctataaaaag agtttcaaaa atattcatta attctataat aaactttaat
99061 gatctcgatg aaaataattt tacaacggta ccactggtca tagattacgt aacaccttgt
99121 gcattatgta aaaaacgatc gcataaacat ccgcatcaac tatcgttgga aaatggtgct
99181 attagaattt acaaaactgg taatccacat agttgtaaag ttaaaattgt tccgttggat
99241 ggtaataaac tgtttaatat tgcacaaaga attttagaca ctaactctgt tttattaacc
```

FIG. 23 (CONT.)

99301 gaacgaggag accatatagt ttggattaat aattcatgga aatttaacag cgaagaaccc
99361 ttgataacaa aactaatttt gtcaataaga catcaactac ctaaggaata ttcaagcgaa
99421 ttactctgtc caagaaaacg aaagactgta gaagctaaca tacgagacat gttagtagat
99481 tcagtagaga ccgataccta tccggataaa cttccgttta aaaatggtgt attggacctg
99541 gtagacggaa tgttttactc tggagatgat gctaaaaaat atacgtgtac tgtatcaacc
99601 ggatttaaat ttgacgatac aaagttcgtc gaagacagtc cagaaatgga agagttaatg
99661 aatatcatta acgatatcca accattaacg gatgaaaata agaaaaatag agagctatat
99721 gaaaaaacat tatctagttg tttatgcggt gctaccaaag gatgtttaac attctttttt
99781 ggagaaactg caactggaaa gtcgacaacc aaacgtttgt taaagtctgc tatcggtgac
99841 ctgtttgttg agacgggtca aacaatttta acagatgtat tggataaagg acctaatcca
99901 tttatcgcta acatgcattt gaaaagatct gtattctgta gcgaactacc tgattttgcc
99961 tgtagtggat caaagaaaat tagatctgac aatattaaaa agttgacaga accttgtgtc
100021 attggaagac cgtgtttctc caataaaatt aataatagaa accatgcgac aatcattatc
100081 gatactaatt acaaacctgt ttttgatagg atagataacg cattaatgag aagaattgcc
100141 gtcgtgcgat tcagaacaca cttttctcaa ccttctggta gagaggctgc tgaaaataat
100201 gacgcgtacg ataaagtcaa actattagac gaggggttag atggtaaaat acaaaataat
100261 agatatagat tcgcatttct atacttgttg gtgaaatggt acagaaaata tcatgttcct
100321 attatgaaac tatatcctac acccgaagag attcctgact ttgcattcta tctcaaaata
100381 ggtactctgt tagtatctag ctctgtaaag catattccat taatgacgga cctctccaaa
100441 aagggatata tattgtacga taatgtggtc actcttccgt tgactacttt ccaacagaaa
100501 atatccaagt attttaattc tagactattt ggacacgata tagagagctt catcaataga

FIG. 23 (CONT.)

```
100561 cataagaaat ttgccaatgt tagtgatgaa tatctgcaat atatattcat agaggatatt
100621 tcatctccgt aaatatatgc tcatatattt atagaagata tcacatatct aaatgaatac
100681 cggaatcata gatttatttg ataatcatgt tgatagtata ccaactatat tacctcatca
100741 gttagctact ctagattatc tagttagaac tatcatagat gagaacagaa gcgtgttatt
100801 gttccatatt atgggatcag gtaaaacaat aatcgctttg ttgttcgcct tggtagcttc
100861 cagatttaaa aaggtttaca ttctagtgcc taatatcaac attttgaaaa tttttaatta
100921 taatatgggt gtagctatga acttgtttaa tgacgaattc atagctgaga atatctttat
100981 tcattccaca acaagttttt attctcttaa ttataacgat aacgtcatta attataacgg
101041 attatctcgc tacaataact ctatttttat cgttgatgag gcacataata tctttgggaa
101101 taatactgga gaacttatga ccgtgataaa aaataaaaac aagattcctt ttctactatt
101161 gtctggatct cccattacta acacacctaa tactctgggt catattatag atttaatgtc
101221 cgaagagacg atagattttg gtgagattat tagtcgtggt aagaaagtaa ttcagacact
101281 tcttaacgaa cgcggtgtga atgtacttaa ggatttgctt aaaggaagaa tatcatatta
101341 cgaaatgcct gataaagatc taccaacgat aagatatcac ggacgtaagt ttctagatac
101401 tagagtagta tattgtcaca tgtctaaact tcaagagaga gattatatga ttactagacg
101461 acagctatgt tatcatgaaa tgtttgataa aaatatgtat aacgtgtcaa tggcagtatt
101521 gggacaactt aatctgatga ataatttaga tactttattt caggaacagg ataaggaatt
101581 gtacccaaat ctgaaaataa ataatggcgt gttatacgga gaagaattgg taacgttaaa
101641 cattagttcc aaatttaaat actttattaa tcggatacag acactcaacg gaaaacattt
101701 tatatacttt tctaattcta catatggcgg attggtaatt aaatatatca tgctcagtaa
```

FIG. 23 (CONT.)

```
101761 tggatattct gaatataatg gttctcaggg aactaatcca catatgataa acggcaaacc
101821 aaaaacattt gctatcgtta ctagtaaaat gaaatcgtct ttagaggatc tattagatgt
101881 gtataattct cctgaaaacg atgatggtag tcaattgatg tttttgtttt cgtcaaacat
101941 tatgtccgaa tcctatactc tgaaagaggt aaggcatatt tggtttatga ctatcccaga
102001 tactttttct caatacaacc aaattcttgg acgatctatt agaaaattct cttacgccga
102061 tatttctgaa ccagttaatg tatatctttt agccgccgta tattccgatt tcaatgacga
102121 agtaacgtca ttaaacgatt acacacagga tgaattgatt aatgttttac catttgacat
102181 caaaaagctg ttatatctaa aatttaagac taaagaaacg aatagaatat actctattct
102241 tcaagagatg tctgaaacgt attctcttcc accacatcca tcaattgtaa aagttttatt
102301 gggagaattg gtcagacaat tttttataa taattctcgt attaagtata acgactccaa
102361 gttacttaaa atggttacat cagttataaa aaataaagaa gacgctagga attacataga
102421 tgatattgta aacggtcact tctttgtatc gaataaagta tttgataaat ctcttttata
102481 caaatacgaa aacgatatta ttacagtacc gtttagactt tcctacgaac catttgtttg
102541 gggagttaac tttcgtaaag aatataacgt ggtatcttct ccataaaact gatgaaatat
102601 ataaagaaat aaatgtcgag ctttgttacc aatggatacc ttccagttac attggaacca
102661 cacgagctga cgttagacat aaaaactaat attaggaatg ccgtatataa gacgtatctc
102721 catagagaaa ttagtggtaa aatggccaag aaaatagaaa ttcgtgaaga cgtggaatta
102781 cctctcggcg aaatagttaa taattctgta gttataaacg ttccgtgtgt aataacctac
102841 gcgtattatc acgttgggga tatagtcaga ggaacattaa acatcgaaga tgaatcaaat
102901 gtaactattc aatgtggaga tttaatctgt aaactaagta gagattcggg tactgtatca
```

FIG. 23 (CONT.)

102961 tttagcgatt caaagtactg ctttttttcga aatggtaatg cgtatgacaa tggcagcgaa
103021 gtcactgccg ttctaatgga ggctcaacaa ggtatcgaat ctagttttgt ttttctcgcg
103081 aatatcgtcg actcataaaa aagagaatag cggtaagtat aaacacgaat actatggcaa
103141 taattgcgaa tgttttattc tcttcgatat atttttgata atatgaaaaa catgtctctc
103201 tcaaatcgga caaccatctc ataaaatagt tctcgcgcgc tggagaggta gttgctgctc
103261 gtataatctc cccagaataa tatacttgcg tgtcgtcgtt caatttatac ggatttctat
103321 agttctctgt tatataatgc ggttttccat catgattaga cgacgacaat agtgttctga
103381 atttagatag ttgatcagaa tgaatgttta ttggcgttgg aaaaattatc catacagcgt
103441 ctgcagagtg gttgatagtt gttcctagat atgtaaaata atccaactta ctaggcagca
103501 aattgtctag ataaaatact gaatcaaacg gtgcagacgt attggcggat ctaatggaat
103561 ccaattgatt aactatcttt tgaaaatata catttttatg atccaatact tgtaagaata
103621 tagaaataat gataagtcca tcatcgtgtt tttttgcctc ttcataagaa ctatattttt
103681 tcttattcca atgaacaaga ttaatctctc cagagtattt gtacacatct atcaagtgat
103741 tggatccata atcgtcttcc tttccccaat atatatgtag tgatgataac acatattcat
103801 tggggagaaa ccctccactt atatatcctc ctttaaaatt aatccttact agttttccag
103861 tgttctggat agtggttggt ttcgactcat tataatgtat gtctaacggc ttcaatcgcg
103921 cgttagaaat tgctttttta gtttctatat taataggaga tagttgttgc ggcatagtaa
103981 aaatgaaatg ataactgttt aaaaatagct cttagtatgg gaattacaat ggatgaggaa
104041 gtgatatttg aaactcctag agaattaata tctattaaac gaataaaaga tattccaaga
104101 tcaaaagaca cgcacgtgtt tgctgcgtgt ataacaagtg acggatatcc gttaatagga
104161 gctagaagaa cttcattcgc gttccaggcg atattatctc aacaaaattc agattctatc

FIG. 23 (CONT.)

```
104221 tttagagtat ccactaaact attacggttt atgtactaca atgaactaag agaaatcttt
104281 agacggttga gaaaaggttc tatcaacaat atcgatcctc actttgaaga gttaatatta
104341 ttgggtggta aactagataa aaaggaatct attaaagatt gtttaagaag agaattaaaa
104401 gaggaaagtg atgaacgtat aacagtaaaa gaattcggaa atgtaattct aaaacttaca
104461 acgcgcgata aattatttaa taaagtatat ataggttatt gcatggcgtg ttttattaat
104521 caatcgttgg aggatttatc gcatactagt atttacaatg tagaaattag aaagattaaa
104581 tcattaaatg attgtattaa cgacgataaa tacgaatatc tgtcttatat ttataatatg
104641 ctagttaata gtaaatgaac ttttacagat ctagtataat tagtcagatt attaagtata
104701 atagacgact agctaagtct attatttgcg aggatgactc tcaaattatt acactcacgg
104761 cattcgttaa ccaatgccta tggtgtcata aacgagtatc cgtgtccgct attttattaa
104821 ctactgataa caaaatatta gtatgtaaca gacgagatag ttttctctat tctgaaataa
104881 ttagaactag aaacatgttt agaaagaaac gattatttct gaattattcc aattatttga
104941 acaaacagga aagaagtata ctatcgtcat tttttctct agatccagct actgctgata
105001 atgatagaat agacgctatt tatccgggtg gcatacccaa aaggggtgag aatgttccag
105061 agtgtttatc cagggaaatt aaagaagaag ttaatataga caattctttt gtattcatag
105121 acactcggtt ttttattcat ggcatcatag aagataccat tattaataaa tttttgagg
105181 taatcttctt tgtcggaaga atatctctaa cgagtgatca aatcattgat acatttaaaa
105241 gtaatcatga aatcaaggat ctaatatttt tagatccgaa ttcaggtaat ggactccaat
105301 acgaaattgc aaaatatgct ctagatactg caaaactcaa atgttatggc catagaggat
105361 gttattacga atcattaaaa aaattaactg aggatgattg attagaaaat ataaattaat
```

FIG. 23 (CONT.)

```
105421 ttaccatcgt gtatttttat aacgggattg tccggcatat catgtagata gttaccgtct
105481 acatcgtata ctcgaccatc tacgccttta aatcctctat ttattgacat taatctatta
105541 gaattggaat accaaatatt agtaccctca attagtttat tggtaatatt tttgttagac
105601 gatagatcga tggctcttga aaccaaggtt ttccaaccgg actcattgtc gatcggtgag
105661 aagtcttttt cattagcatg aatccattct aatgatgtat gtttaaacac tctaaacaat
105721 tggacaaatt ctttgatttt gctttgaatg atttcaaata ggtcttcgtc tacagtaggc
105781 ataccattag ataatctagc cattataaag tgcacgttta catatctacg ttctggagga
105841 gtaagaacgt gactattgag acgaatggct cttcctacta tctgacgaag agacgcctcg
105901 ttccatgtca tatctaaaat gaagatatca ttgattgaga agaagctaat accctcgcct
105961 ccactagaag agaatacgca tgttttaatg cattctccgt tagtgtttga ttcttggtta
106021 aactcagcca ccgccttgat tctagtatct tttgttctag atgagaactc tatattagag
106081 ataccaaaga ctttgaaata tagtaataag atttctattc ctgactgatt aacaaatggt
106141 tcaaagacta gacatttacc atgggatgct aatattccca aacatacatc tataaatttg
106201 acgcttttct cttttaattc agtaaataga gagatatcag ccgcactagc atcccctccc
106261 aatagttctc cccttttaaa ggtatctaat gcagatttag aaaattctct atctcttaat
106321 gaatttttaa aatcattata tagtgttgct atctcttgcg cgtattcgcc cggatcacga
106381 ttttgtcttt caggaaagct atcgaacgta aacgtagtag ccatacgtct cagaattcta
106441 aatgatgata tacctgtttt tatttcagcg agtttagcct tttgataaat ttcttcttgc
106501 tttttcgaca tattaacgta tcgcattaat actgttttct tagcgaatga tgcagaccct
106561 tctacgtcat caaaaataga aaactcgtta ttaactatgt acgaacatag gcctcctagt
```

FIG. 23 (CONT.)

106621 ttggagacta attctttttc atcaactaga cgtttattct caaatagcga ttggtgttgt
106681 aaggatcctg gtcgtagtaa gttaaccaac atggtgaatt cttgcacact attgacgata
106741 ggtgtagccg ataaacaaat catcttatgg ttttttaatg cgatggtctt agataaaaaa
106801 ttatatactg aacgagtagg acggatctta ccatcttctt tgattaatga tttagaaatg
106861 aagttatgac attcatcaat aatgacgcat attctactct tggaattaat agttttgata
106921 ttagtaaaaa atttatttct aaaatttgga tcatcgtaat taataaaaat acaatccttc
106981 gttatctctg gagcgtatct gagtatagtg ttcatccaag gatcttctat caaagccttt
107041 ttcaccaata agataatagc ccaattcgta taaatatcct taagatgttt gagaatatat
107101 acagtagtca ttgttttacc gacacccgtt tcatggaaca ataaaagaga atgcatactg
107161 tctaatccta agaaaactct tgctacaaaa tgttgataat ccttgaggcg tactacgtcc
107221 gaccccatca tttcaacagg catattagta gttctgcgca atgcataatc gatataggcc
107281 gcgtgtgatt tactcattta tgagtgataa gtaataacta tgttttaaaa atcacagcag
107341 tagtttaact agtcttctct gatgtttgtt ttcgatactt tttgaatcag aagtcatact
107401 agaataaagc aacgagtgaa cgtaatagag agcttcgtat actctattcg aaaactctaa
107461 gaacttatta atgaattccg tatccactgg attgtttaaa atactaaatt gaacactgtt
107521 cacatccttc caagaagaag acttagtgac ggacttaaca tgagacataa ataaatccaa
107581 atttttttta caaacatcac tagccaccat aatggcgcta tcttttaacc agctatcgct
107641 tacgcatttt agcagtctaa catttttaaa gagactacaa tatattctca tagtatcgat
107701 tacacctcta ccgaataaag ttggaagttt aataatacaa tatttttcgt ttacaaaatc
107761 aaataatggt cgaaacacgt cgaaggttaa catcttataa tcgctaatgt atagattgtt
107821 ttcagtgaga tgattattag atttaatagc atctcgttca cgtttgaaca gtttattgcg

FIG. 23 (CONT.)

```
107881 tgcgctgagg tcggcaacta cggcgtccgc tttagtactc ctcccataat actttacgct
107941 attaatcttt aaaatttcat agactttatc tagatcgctt tctggtaaca tgatatcatg
108001 tgtaaaaagt tttaacatgt cggtcggcat tctatttaga tcattaactc tagaaatctg
108061 aagaaagtaa ttagctccgt attccagact aggtaatggg cttttaccta gagacagatt
108121 aagttctggc aatgtttcat aaaatggaag aaggacatgc gttccctccc ggatattttt
108181 tacaatttca tccatttaca actctatagt ttgttttcat tattattagt tattatctcc
108241 cataatcttg gtaatactta ccccttgatc gtaagatacc ttatacaggt cattacatac
108301 aactaccaat tgtttttgta cataatagat tggatggttg acatccatgg tggaataaac
108361 tactcgaaca gatagtttat ctttccccct agatacatta gccgtaatag ttgtcggcct
108421 aaagaatatc tttggtgtaa agttaaaagt tagggttctt gttccattat tgctttttgt
108481 cagtagttca ttataaattc tcgagatggg tccgttctct gaatatagaa catcatttcc
108541 aaatctaact tctagtctag aaataatatc ggtcttattc ttaaaatcta ttcccttgat
108601 gaagggatcg ttaatgaaca aatccttggc ctttgattcg gctgatctat tatctccgtt
108661 atagacgtta cgttgactag tccaaagact tacaggaata gatgtatcga tgatgttgat
108721 actatgtgat atgtgagcaa agattgttct cttagtggca tcactatatg ttccagtaat
108781 ggcggaaaac tttttagaaa tgttatatat aaaagaattt tttcgtgttc caaacattag
108841 cagattagta tgaagataaa cactcatatt atcaggaaca ttatcaattt ttacatacac
108901 atcagcatct tgaatagaaa cgataccatc ttctggaacc tctacgatct cggcagactc
108961 cggataacca gtcggtggac catcgctaac aataactaga tcatccaaca atctactcac
109021 atatgcatct atataatctt tttcatcttg tgagtaccct ggatacgaaa taaatttatt
```

FIG. 23 (CONT.)

```
109081 atccgtattt ccataataag gtttagtata aacagagagc gatgttgccg catgaacttc
109141 agttacagtc gccgttggtt ggtttatttg acctattact ctcctaggtt tctctataaa
109201 tgatggttta atttgtacat tcttaaccat atatccaata aagctcaatt caggaacata
109261 aacaaattct ttgttgaacg tttcaaagtc gaacgaagag tcacgaataa cgatatcgga
109321 tactggattg aaggttaccg ttacggtaat ttttgaatcg gatagtttaa gactgctgaa
109381 tgtatcttcc acatcaaacg gagttttaat ataaacgtat actgtagatg gttctttaat
109441 agtgtcatta ggagttaggc caatagaaat atcattaagt tcactagaat atccagagtg
109501 tttcaaagca attgtattat tgatacaatt attatataat tcttcgccct caatttccca
109561 aataacaccg ttacacgaag agatagatac gtgattaata catttatatc caacatatgg
109621 tacgtaaccg aatcttccca tacctttaac ttctggaagt tccaaactca gaaccaaatg
109681 attaagcgca gtaatatact gatccctaat ttcgaagcta gcgatagcct gattgtctgg
109741 accatcgttt gtcataactc cggatagaga aatatattgc ggcatatata aagttggaat
109801 ttgactatcg actgcgaaga cattagaccg tttaatagag tcatccccac cgatcaaaga
109861 attaatgata gtattattca ttttctattt aaaatggaaa aagcttacaa taaactccgt
109921 agagaaatat ctataatttg tgagttttcc ttaaagtaac agcttccgta aacgccgtct
109981 ttatctctta gtaagtttat tgtatttata acctttttcct tatcttcata gaatactaaa
110041 ggcaacaaag aaattttttgg ttcttctcta agagctacgt gagacttaac catagacgcc
110101 aacgaatccc tacatatttt agaacagaaa tacccaactt caccaccctt gaatgtctca
110161 atactaatag gtttaaaaac caaatcttga ttacaaaacc aacacttatc aattacacta
110221 tttgtcttaa tagacacatc tgccatagat ttataatact ttggtagtat acaagcgagt
```

FIG. 23 (CONT.)

110281 gcttcttctt tagcgggctt aaagactgct ttaggtgctg aaataaccac atctggaagg
110341 cttactcgct tagccattta attacggaac tattttttta tacttctaat gagcaagtag
110401 aaaacctctc atctacaaaa acatactcgt gtccataatc ctctaccata gttacacgtt
110461 ttttagatct catatgtgct aaaaagtttt cccatactaa ttggttacta ttatttttcg
110521 tataattttt aacagtttga ggttttagat ttttagttac agaagtgata tcgaatattt
110581 tatccaaaaa gaatgaataa ttaattgtct tagaaggagt gttttcttgg caaaagaata
110641 ccaagtgctt aaatatttct actacttcat taatcttttc tgtactcaga ttcagtttct
110701 catcttttac ttgattgatt atttcaaaga ctaacttata atccttttta tttattctct
110761 cgttagcctt aagaaaacta gatacaaaat ttgcatctac atcatccgtg gatatttgat
110821 ttttttccat gatatccaag agttccgaga taatttctcc agaacattga tgagacaata
110881 atctccgcaa tacatttctc aaatgaataa gtttattaga cacatggaag tttgactttt
110941 tttgtacctt tgtacatttt tgaaataccg actcgcaaaa aatacaatat tcatatcctt
111001 gttcagatac tataccgttg tgtctacaac cgctacataa tcgtagattc atgttaacac
111061 tctacgtatc tcgtcgtcca atattttata taaaaacatt ttatttctag acgttgccag
111121 aaaatcctgt aatattttta gttttttggg ctgtgaataa agtatcgccc taatattgtt
111181 accgtcttcc gccaatatag tagttaaatt atccgcacat gcaaaagaac accgcttagg
111241 cggattcagt acaatgttat atttttcgta ccaactcatt taaatatcat aatctaaaat
111301 agttctgtaa tatgtctagc gctaatatat tgatcataat cctgtgcata aattaagata
111361 caacaatgtc tcgaaatcat cgacatggct tcttccatag ttagaagatc gtcgtcaaag
111421 ttagcaacgt gattcatcaa catttgctgt tttgaggcag caaatactga accgtcgcca
111481 ttcaaccatt cataaaaacc atcgtctgaa tccattgata atttcttgta ctggtttttg

FIG. 23 (CONT.)

```
111541 agagctcgca tcaatctagc atttctagct cccggattga aaacagaaag aggatcgtac
111601 atccagggtc cattttctgt aaatagaatc gtataatgtc ccttcaagaa gatatcagac
111661 gatccacaat caaagaattg gtctccgagt ttgtaacaaa ctgcggactt taacctatac
111721 atgataccgt ttagcatgat ttctggtgat acgtcaatcg gagtatcatc tattagagat
111781 ctaaagccgg tgtaacattc tccaccaaac atattcttat tctgacgtcg ttctacataa
111841 aacatcattg ctccattaac gataacaggg gaatgaacag cactacccat cacattagtt
111901 cccaatggat caatgtgtgt aactccagaa catcttccat atcctatgtt aggaggagcg
111961 aacaccactc ttccactatt gccatcgaat gccatagaat aaatatcctt ggaattgata
112021 gaaatcggac tgtcggatgt tgtgatcatc ttcataggat taacaactat gtatggtgcc
112081 gcctgaagtt tcatatcgta actgatgccg tttataggtc tagccacaga aaccaacgta
112141 ggtctaaatc caactataga caaaatagaa gccaatatct gttcctcatc tgtcataact
112201 tgagagcatc cagtatgaat aatcttcatt agatggggat ctaccgcatc atcatcgtta
112261 caataaaaaa ttcccattct aatgttcata attgcttttc taatcatggt atgcatgttt
112321 gctctctgaa tctctgtgga aattagatct gatacacctg taatcactat cggattatcc
112381 tccgtaagac gattaaccaa caacatataa ttataagact ttacttttct aaattcataa
112441 agttgctgga ttaggctata ggtgtctcca tgtacatacg cgttctcgag cgcaggaagt
112501 ttaataccga atagtgccat cagaatagga tgaatatagt aattagtttc tggttttcta
112561 taaataaaag acaaatcttg tgaactagac atatcggtaa aatgcatgga ttggaatcgt
112621 gtagtcgaca gaagaatatg atgattagat ggagagtata ttttatctaa ctctttgagt
112681 tggtcaccga ttctaggact agctcgagaa tgaataagta ctaaaggatg agtacatttc
```

FIG. 23 (CONT.)

112741 acagaaacac tagcattgtt caatgtgctc tttacatggg taaggagttg aaatagctcg
112801 tttctatttg ttctgacaat atttagttta ttcataatgt taagcatatc ctgaatagta
112861 aagttagatg tgtcatactt gttagtagtt agatatttag caattgcatt cccatcattt
112921 ctcaatctcg tactccaatc atgtgtagat gctacttcgt cgatggaaac catacaatcc
112981 tttttgatag gctgttgaga ttgattattt cctgcacgtt taggtttggt acgttgattt
113041 ctagcccctg cggatataaa gtcatcgtct acaatttggg acaatgaatt gcatacacta
113101 caagacaaag atttatcaga agtgtgaata tgatcttcat ctaccaaaga aagagtttga
113161 ttagtataac tagattttag tcctgcgtta gatgttaaaa aaacatcgct attgaccacg
113221 gcttccatta tttatattcg tagtttttac tcgaaagcgt gattttaata tccaatctta
113281 ttacttttgg aatcgttcaa aacctttgac tagttgtaga atttgatcta ttgccctacg
113341 cgtatactcc cttgcatcat atacgttcgt caccagatcg tttgtttcgg cctgaagttg
113401 gtgcatatct ctttcaacat tcgacatgag atccttaagg gccatatcgt ctagattttg
113461 ttgagatgct gctcctggat ttggattttg ttgtgctgtt gtacatactg taccaccagt
113521 aggtgtagga gtacatacag tggccacaat aggaggttga ggaggtgtaa ccgttggagt
113581 agtacaagaa atatttccat ccgattgttg tgtacatgta gttgttggta acgtctgaga
113641 aggttgggta gatggcggtg tcgtcgtctt ttgatcttta ttaaatttag agataatatc
113701 ctgaacagca ttgctcggcg tcaacgctgg aaggagtgaa ctcgccggcg catcagtatc
113761 ttcagacagc caatcaaaaa gattagacat atcagatgat gtattagttt gttgtcgtgg
113821 ttttggtgta ggaacagtac tactaggtag aagaatagga gccggtgtag ctgttggaac
113881 cggctgtgga gttatatgaa tagttggttg tagcggttgg ataggctgtc tgctggcgac

FIG. 23 (CONT.)

113941 cgtcatatta tctctagcta gttgttctcg caactgtctt tgataatacg actcttgaga
114001 ctttagtcct atttcaatcg cttcatcctt tttcgtatcc ggatcctttt cttcagaata
114061 atagattgac gactttggtg tagaggattc tgccagcccc tgtgagaact tgttaaagaa
114121 gtccatttaa ggctttaaaa ttgaattgcg attataagat taaatggcag acacagacga
114181 tattatcgac tatgaatccg atgatctcac cgaatacgag gatgatgaag aagaggaaga
114241 agatggagag tcactagaaa ctagtgatat agatcccaaa tcttcttata agattgtaga
114301 atcagcatcc actcatatag aagatgcgca ttccaatctt aaacatatag ggaatcatat
114361 atctgctctt aaacgacgct atactagacg tataagtcta tttgaaatag cgggtataat
114421 agcagaaagc tataacttgc ttcaacgagg aagattacct ctagtttcag aattttctga
114481 cgaaacgatg aagcaaaata tgctacatgt aattatacaa gagatagagg agggttcttg
114541 tcctatagtc atcgaaaaga acggagaatt gttgtcggta aacgattttg acaaagatgg
114601 tctaaaattc catctagact atattatcaa aatttggaaa cttcaaaaac gatattagaa
114661 tttatacgaa tatcgttctc taaatgtcac aatcaagtct cgcatgttca gcaatttatt
114721 gtcgtacttt atatcgtgtt cattaacgat atcttgcaaa atagtaatga ttctatcttc
114781 cttcgataga tattcttcag agattattgt cttatatttt ttcttgttat ccgatatgaa
114841 tttgataaga ctttgaacat tattgatacc cgtctgttta atttttcta cagatatttt
114901 agttttggca gattctatcg tatctgtcaa tagacatcca acatcgacat tcgacgtcaa
114961 ttgtctataa atcaacgtat aaattttaga aataacatta gcgaattgtt gtgcattgat
115021 gtcgttattc tgaaacagta tgattttagg tagcattttc ttaacaaaga gaacgtattt
115081 attgttactc agttgaacag atgatatatc cagattacta acgcatctga ttccgtatac
115141 caaactttca gaagaaatgg tgtacaattg tttgtattca ttcaatgtct ctttttcaga

FIG. 23 (CONT.)

115201 aattagttta gagtcgaata ctgcaataat tttcaagaga tagttttcat cagataagat
115261 tttatttagt gtagatatga taaaactatt gttttgttgg agaacttgat acgccgcgtt
115321 ctctgtagtc gacgctctca aatgggaaac aatctccatt atttttttgg aatcggatac
115381 tatatcttcg gtatcttgac gcagtctagt atacatagag ttaagagaga ttagagtttg
115441 tacattaagc aacatgtctc taaatgtggc tacaaacttt tcctttttca cataatctag
115501 tttattatat accgatttca caacggcacc agatttaagg aaccagaatg aaaaactctg
115561 ataactacaa tatttcatca tagttacgat tttatcatct tctatagttg gtgtaatagc
115621 gcataccttt ttctccaaga ctggaaccaa cgtcataaaa atgtttaaat caaaatccat
115681 atcaacatct gatgcgctaa gaccagtctc gcgttcaaga ttatctttac taatggtgac
115741 gaactcatca tatagaactc taagtttgtc cattatttat ttacagattt agttgtttaa
115801 tttatttgtg ctcttccaga gttgggatag tatttttcta acgtcggtat tatattatta
115861 ggatctacgt tcatatgtat cataatatta atcatccacg ttttgataaa tctatcttta
115921 gcttctgaaa taacgtattt aaacaaagga gaaaaatatt tagctacggc atcagacgca
115981 ataacatttt ttgtaaatgt aacgtattta gacgacagat cttcgttaaa aagtttccca
116041 tctatgtaga atccatcggt tgttaacacc attcccgcgt cagattgaat aggagtttga
116101 atagtttgtt ttggaaatag atccttcaat aacttatagt tgggtgggaa aaaatcgatt
116161 ttatcactag actctttctt ttttactatc attacctcat gaactatttc ttgaatgagt
116221 atatgtattt tctttcctat atcggacgcg ttcattggaa aatataccat gtcgttaact
116281 ataagaatat ttttatcctc gtttacaaac tgaataatat cagatgtagt tcgtaaacga
116341 actatatcat caccagcaca acatctaact atatgatatc cactagtttc ctttagccgt

FIG. 23 (CONT.)

116401 ttattatctt gttccatatt agcagtcatt ccatcattta agaaggcgtc aaagataata
116461 gggagaaatg acattttgga ttctgttacg actttaccaa aattaaggat atacggactt
116521 actatctttt tctcaacgtc gatttgatga acacacgatg aaaatgtgct tctatgagat
116581 tgatcatgta gaaaacaaca agggatacaa tatttccgca tatcatgaaa tatattaaga
116641 aatcccacct tattatattt ccccaaagga tccatgcatg taaacattat gccgttatca
116701 ttaataaaga cttctttctc atcggatttg taaaagttgt tactgatttt tttcattcca
116761 ggatctagat aattaataat gatgggtttt ctattcttat tctttgtatt ttggcatatc
116821 ctagaccagt aaacagtttc cactttggta aaatcagcag acttttgaac gctattaaac
116881 atggcattaa tggcaataac taaaaatgta aaatattttt ctatgttagg aatatggttt
116941 ttcactttaa tagatatatg gtttttggcc aaaatgatag atattttttt atccgaggat
117001 agtaaaatat tattagtcgc cgtctctata aaaatgaagc tagtctcgat atccaatttt
117061 attctagaat tgataggagt cgccaaatgt accttatacg ttatatctcc cttgatgcgt
117121 tccatttgtg tatctatatc ggacacaaga tctgtaaata gttttacgtt attaatcatc
117181 acggtatcgc cgtcgctaga taacgctaat gtaccatcca agtcccaaat ggagagattt
117241 aactgttcat cgtttagaat aaaatgatta ccggtcatat taataaagtg ttcatcgtat
117301 ctagataaca acgacttata attaatgtcc aagtcttgaa ctcgctgaat gatctttttt
117361 aacccagtta gttttagatt ggtacgaaat atattgttaa actttgattc tacagtaatg
117421 tccaaatcta gttgtggaaa tacttccatc aacattgttt caaacttgat aatattatta
117481 tctacatctt catacgatcc aaattccgga atagatgtat cacatgctct tgccacccag
117541 ataaccaaaa agtcacacgc tccaggatat acattgtata aaaagctatc gtttttagt

FIG. 23 (CONT.)

```
117601 agtgtttttt tctgagtata tacgaaggga ttaaaaatag tattatcaac gtaactatat
117661 tccaaattat tcttatgaga atagataata atatcgtcct taatatctaa caaatttcct
117721 aaatatccct ttaattgagt cattcgaagc gtcaatagaa tatgtctctt aactatttcc
117781 ggctgttgta tatttaaatg acttcgtaaa aaataatata tgggcgactt ctcatctatg
117841 taatcatatg gagtgagata tagggctcgt tctacctcct gccccttacc cacctgtaat
117901 accaattgcg gacttactat atatcgcata tttatatcgt ggggtaaagt gaaaatctac
117961 taccgatgat gtaagtctta caatgttcga accagtacca gatcttaatt tggaggcctc
118021 cgtagaacta ggggaggtaa atatagatca aacaacacct atgataaagg aaaatagcgg
118081 ttttatatcc cgtagtagac gtctattcgc ccatagatct aaggatgatg agagaaaact
118141 agcactacga ttctttttac aaagacttta tttttagat catagagaga ttcattattt
118201 gttcagatgc gttgacgctg taaaagacgt cactattacc aaaaaaaata acattatcgt
118261 ggcgccttat atagcacttt taactatcgc atcaaaagga tgcaaactta cagaaacaat
118321 gattgaagca tttttttccag aactatataa tgaacatagt aagaaattta aattcaactc
118381 tcaagtatcc atcatccaag aaaaactcgg ataccagttt ggaaactatc acgtttatga
118441 ttttgaaccg tattactcta cagtagctct ggctattcga gatgaacatt catctggcat
118501 ttttaatatc cgtcaagaga gttatctggt aagttcatta tctgaaataa catatagatt
118561 ttatctaatt aatctaaaat ctgatcttgt tcaatggagt gctagtacgg gcgctgtaat
118621 taatcaaatg gtaaatactg tattgattac agtgtatgaa aagttacaac tggtcataga
118681 aaatgattca caatttacat gttcattggc tgtggaatca aaacttccaa taaaattact
118741 taaagataga aatgaattat ttacaaaatt cattaacgag ttaaaaaaga ccagttcatt
118801 caagataagc aaacgcgata aggatacgct actaaaatat tttacttagg actggagtta
```

FIG. 23 (CONT.)

118861 gaatttatag acgactcatt tcgtttatca ttgttactat tattactatt actatcatta
118921 ttagtgttgg cattattagt attcttcttg tcatcttgtt cagaaatata cagcaatgct
118981 atacctaata ctaaatacat tatcatgctc gcaatggctc taacaacaac gaaccaaaat
119041 gaatttggtc gtagcttttg ttcacaaaaa tacataaaga aatgtctaca taaatctatg
119101 gcgccattgg ctacttgaaa tagcgccagt cctcctacag attttaatat agctgtataa
119161 catgacattt attcatcatc aaaagagaca gagtcaccat ctgtcatatt tagatttttt
119221 ttcatgtgtt caaagtatcc tctactcatt tcattataat agtttatcat acttagaatt
119281 ttaggacgga tcaatgagta agacttgact agatcgtcag tagtaatttg tgcatcgtct
119341 attctgcatc cgcttcgtcg aataatgtat agcatcgctt tgagattctc catagctatc
119401 aagtctttat acaatgacat ggaaatatct gtgaatactt tatacttctc caacatcgat
119461 gccttaacat catcgcctac tttagcattg aaaatacgtt ctattgtgta gatggatgta
119521 gcaagatttt taaacaacaa tgccatctta cacgatgatt gcctcaagtc tccaatcttt
119581 tgtttagaac gattagctac agagttcaac gcttggctga ctagcatatt attatcttta
119641 gaaattgtat tcttcaatga ggcgtttatc atatctgtga tttcgttagt catattacag
119701 tctgactggg ttgtaatgtt atccaacata tcacctatgg atacggtaca cgtaccagca
119761 tttgtaataa tcctatctaa gatgttgtat ggcattgcgc agaaaatatc ttctcctgta
119821 atatctccac tctcgataaa tctactcaga ttattcttaa atgccttatt ctctggagaa
119881 aagatatcag tgtccatcat ttcattaata gtatacgcag aaaagatacc acgagtatca
119941 attctatcca agatacttat cggttccgag tcacagataa tggtttcctc tccttcggga
120001 gatcctgcat agaaatatct aggacaatag tttctatact gtctgtaact ctgataatct

FIG. 23 (CONT.)

```
120061 ctaaagtcac taactgatac catgaaattg agaagatcaa acgctgaagt aatcaatttt
120121 tctgcctcgt ttttactaca actagttttc atcaatgtag cgacgatgta ttgtttagtt
120181 actcttggtc taatactgat gatagagata ttattgcttc ccataatgga tcttctagta
120241 gtcaccttaa agcccattga tgcgaatagc agatagataa agtcttggta tgactccttt
120301 ctaatatagt acggactacc tttgtcaccc aactttatac ccacataagc cataacaacc
120361 tctttaatag ccgtttcatg aggtttatca gccatgagcc tgagtagttg gaagaatctc
120421 atgaatcccg tctcagaaag tcctatatgc atgatagatt tatctttcct gggaaactct
120481 cgtatagtca tagatgaaat actcttcaaa gtttctgaaa taagattagt aacagtctta
120541 cctccgacta ctctgggtaa caaacatact ctaataggtg ttttctctgc ggagataata
120601 tcagaaagga tagagcaata agtagtatta ttgtgattat aaagaccgaa tacataacag
120661 gtagaattta taaacatcat gtcctgaagg ttttagact tgtattcctc gtaatccata
120721 ccgtcccaaa acatggattt ggtaactttg atagccgtag atctttgttc cttcgccaac
120781 aggttaaaga aattaataaa gaatttgttg tttctattta tgtccacaaa ttgcacgttt
120841 ggaagcgcca cggttacatt cactgcagca ttttgaggat cgcgagtatg aagtacgatg
120901 ttattgttta ctggtatatc tggaaagaaa tctaccagtc taggaataag agattgatat
120961 cgcatagaaa tagtaaagtt tataatctca tcatcgaaga gcattttgtt accattgtaa
121021 taaatatcca ctctgtcata tgtataaatg aagtactgtt caaacatgat gagatgttta
121081 tatgttggca tagtagtgag atcgacgttt ggtaatggca atgtattaag attaactcca
121141 taatgtctag cagcatctgc gatgttataa gcgtcgtcaa agcggggtcg atcttgtatt
121201 gttatatatt gtctaacacc tataagatta tcaaaatctt gtctgcttaa tacaccgtta
```

FIG. 23 (CONT.)

```
121261 acaattttg ccttgaattc ttttattggt gcattaataa catccttata gaggatgtta
121321 aacaaataag tgttatcaaa gttaagatct ggatatttct tttctgctag aacatccatt
121381 gagtcggagc catctggttt aatataacca ccgataaatc tagctctgta ttctgtatcc
121441 gtcaatctaa tattaagaag gtgttgagtg aaaggtggaa gatcgtaaaa gctgtgagta
121501 ttaatgatag gattagtttc cgaactaatg ttaattgggg tattaataat atctatattt
121561 ccagcgttaa gtgtaacatt aaacagtttt aattcacgtg acgtggtatc aattaaataa
121621 ttaatgccca atttggatat agcagcctga agctcatctt gtttagttac ggatcctaat
121681 gagttattaa gcaatatatc gaacggatga acgaaggttg ttttaagttg gtcacatact
121741 ttgtaatcta gacatagatg cggaagaacg gtagaaacta tacgaaataa atattcagag
121801 tcctctaatt gatcaagagt aactattgac ttaataggca tcatttattt agtattaaat
121861 gacgaccgta ccagtgacgg atatacaaaa cgatttaatt acagagtttt cagaagataa
121921 ttatccatct aacaaaaatt atgaaataac tcttcgtcaa atgtctattc taactcacgt
121981 taacaacgtg gtagatagag aacataatgc cgccgtagtg tcatctccag aggaaatatc
122041 ctcacaactt aatgaagatc tatttccaga tgatgattca ccggccacta ttatcgaacg
122101 agtacaacct catactacta ttattgacga tactccacct cctacttttc gtagagagtt
122161 attgatatcg gaacaacgtc aacaacgaga aaaaagattt aatattacag tatcgaaaaa
122221 tgctgaagca ataatggaat ctagatctat gataacttct atgccaacac aaacaccatc
122281 cttgggagta gtttatgata aagataaaag aattcagatg ttggaggatg aagtggttaa
122341 tcttagaaat caacgatcta atacaaaatc atctgataat ttagataatt ttaccaaaat
122401 actatttggt aagactccgt ataaatcaac agaagttaat aagcgtatag ccatcgttaa
122461 ttatgcaaat ttgaacgggt ctcccttatc agtcgaggac ttggatgttt gttcagagga
```

FIG. 23 (CONT.)

122521 tgaaatagat agaatctata aaacgattaa acaatatcac gaaagtagaa aacaaaaaat
122581 tatcgtcact aacgtgatta ttattgtcat aaacattatc gagcaagcat tgctaaaact
122641 cggatttgaa gaaatcaaag gactgagtac cgatatcact tcagaaatta tcgatgtgga
122701 gatcggagat gactgcgatg ctgtagcatc aaaactagga atcggtaaca gtccggttct
122761 taatattgta ttgtttatac tcaagatatt cgttaaacga attaaaatta tttaatttaa
122821 tacattccca tatccagaca acaatcgtct ggattaatct gttcctgtcg tctcataccg
122881 gacgacatat taatcttttt attagtaggc atctttttag atggtttctt tttcccagca
122941 ttaactgagt cgatacctag aagatcgtga ttgatctctc cgaccattcc acgaacttct
123001 aattggccgt ctctaacggt accataaact attttaccag cattagtaac agcttggaca
123061 atctgaccat ccatcgcatt gtacgatgta gtagtaactg ttgttctacg tctaggagca
123121 ccagaagtat ttttggagcc cttggaggct gatgtagaag aagacgagga ttttgatttt
123181 ggtttacatg taatacattt tgaactcttt gattttgtat cacatgcgcc ggcagtcaca
123241 tctgtttgag aattaagatt attgttgcct cctttgacgg ctgcatctcc accgatttgc
123301 gctagtagat ttttaagctg tggtgtaatc ttattaactg tttcgatata atcatcgtaa
123361 ctgcttctaa cggctaaatt tttttatcc gccatttaga agctaaaaat atttttattt
123421 atacagaaga tttaactaga ttatacaatg aactaatatg atcctttcc agattattta
123481 caaacttggt atttttggt tctggaggag gcgaatttaa attcggactt ggattcggat
123541 tttgtgagtt cttgatctta ttatacatcg agtataggat ggcgacggta actgctacac
123601 aaataccgat caacaaaaga ataccaatca tttattgaca ataacttcac tattgatcaa
123661 gtatgcaata tatcatcttt tcactaaata agtagtaata atgattcaac aatgtcgaga

FIG. 23 (CONT.)

```
123721 tatatggacg ataataattt agttcatgga aatatcgcta tgattggtat gaatgactcc
123781 gctaactctg tggggcgcgc agtgctttcc ccacatagaa taaattagca ttccgactgt
123841 gataataata ccaagtataa acgccataat actcaatact ttccatgtac gagtgggact
123901 ggtagactta ctaaagtcaa taaaggcgaa gatacacgaa agaatcaaaa gaatgattcc
123961 agcgattagc acgccggaaa aataatttcc aatcataagc atcatgtcca tttaactaat
124021 aaaaatttta aatcgccgaa tgaacaaagt ggaatataaa ccatataaaa acaatagttt
124081 gtactgcaaa aataatatct atttttgttt tcgaagatat ggtaaaatta aatagtagta
124141 cacagcatgt tataactaac agcagcaacg gctcgtaatt acttatcatt tactagacga
124201 aaaggtggtg ggatattttc ttgctcaaat aatacgaata tatcacccat ccattttatg
124261 cgatgtttat atactctaat ctttaataga tctatagacg acgggtttac caacaatata
124321 gattttatcg attcatctaa tttaaaccct tccttaaacg tgaatgatct attatctggc
124381 ataacgatga ccctacctga tgaatcggac aatgtactgg gccatgtaga ataaattatc
124441 aacgaattat cgtctacgaa catttatatc atttgtttta attttaggac gcgaataaat
124501 agatataaaa tagaaaataa cagatattac aaccagtgtt atggccgcgc ccaaccaggt
124561 aggcagtttt attttatctt ttactacagg ttctcctgga tgtacgtcac caacggcgga
124621 cgtagttcta gtacaattag acgtaagttc cgcttgggaa ttttttaacg ctaaagagtt
124681 aacgttaatc gtgcacccaa cgtatttaca tctagttctt tgaacatctt gattataata
124741 taaccatttt ctatctctag attcgtcggt gcactcatgt aaccaacata ccctaggtcc
124801 taaatattta tctccggaat tagattttgg ataattcgcg caccaacaat ttctatttcc
124861 tttatgatcg ttacaaaaga cgtataatgc cgtatcccca aaagtaaaat aatcaggacg
```

FIG. 23 (CONT.)

124921 aataattcta ataaactcag aacaatatct cgcatccata tgtttggagc aaatatcgga
124981 ataagtagac atagccggtt tccgttttgc acgtaaccat tctaaacaat tggggtttcc
125041 aggatcgttt ctacaaaatc cagtcatgaa atcgtcacaa tgttctgtct tgtaattatt
125101 attaaatatt tttggacagt gtttggtatt tgtcttagaa caacattttg ccacgctatc
125161 actatcgccc aggagataat cctttttat aaaatgacat cgttgcccgg atgctatata
125221 atcagtagcg tgttttaaat ccttaatata ttcaggagtt acctcgttct gataatagat
125281 taatgatcca ggacgaaatt tgaaagaact acatggttct ccatgaatta atacatattg
125341 tttagcaaat tcaggaacta taaaactact acaatgatct atcgacatac catctatcaa
125401 acaaaacttg ggtttaattt ctcccggaga tgtttcataa tagtacgtat aactttcttc
125461 tgcaaactta acagctctat tatattcagg ataattaaaa cctaattcca tatatttgtc
125521 tcgtatatct gctattcctg gtgctatttt gattctatta agagtaacag ctgcccccat
125581 tcttaataat cgtcagtatt taaactgtta aatgttggta tatcaacatc taccttattt
125641 cccgcagtat aaggtttgtt gcaggtatac tgttcaggaa tggttacatt tatacttctt
125701 ctatagtcct gtctttcgat gttcatcaca tatgcaaaga acagaataaa caaaataatg
125761 taagaaataa tattaaatat ctgtgaattc gtaaatacat tgattgccat aataattaca
125821 gcagctacaa tacacacaat agacattccc acagtgttgc cattacctcc acgatacatt
125881 tgagttacta agcaataggt aataactaag ctagtaagag gcaatagaaa agatgagata
125941 aatatcatca atatagagat tagaggaggg ctatatagag ccaagacgaa caaaatcaaa
126001 ccgagtaacg ttctaacatc attattttg aagattccca aataatcatt cattcctcca
126061 taatcgtttt gcatcatacc tccatcttta ggcataaacg attgctgctg ttcctctgta
126121 aataaatctt tatcaagcac tccagcaccc gcagagaagt cgtcaagcat attgtaatat

FIG. 23 (CONT.)

```
126181 cttaaataac tcatttatat attaaaaaat gtcactatta aagatggagt ataatcttta
126241 tgccgaacta aaaaaaatga cttgtggtca acccctaagt ctttttaacg aagacgggga
126301 tttcgtagaa gttgaaccgg gatcatcctt taagtttctg atacctaagg gattttacgc
126361 ctctccttcc gtaaagacga gtctagtatt tgaaacatta acaacgaccg ataataaaat
126421 cactagtatc aatccaacaa atgcgccaaa gttatatcct cttcaacgca aagtcgtatc
126481 tgaagtagtt tctaatatga ggaaaatgat cgaatcaaaa cgtcctctat acattactct
126541 tcacttggcg tgtggatttg gtaagactat taccacgtgt tatcttatgg ctacacacgg
126601 tagaaaaacc gtcatttgcg tacccaataa aatgttaata catcaatgga agacacaggt
126661 agaggcagtc ggattggaac ataagatatc catagatgga gtaagtagtc tattaaagga
126721 actaaagact caaagtccgg atgtattaat agtagtcagt agacatctga caaacgatgc
126781 cttttgtaaa tatatcaata agcattatga tttgttcatc ttggatgaat cacatacgta
126841 taatctgatg aacaatacag cagttacaag atttttagcg tattatcctc cgatgatgtg
126901 ttatttttta actgctacac ctagaccagc taaccgaatt tattgtaaca gtattattaa
126961 tattgccaag ttatccgatc taaaaaaaac tatctatgcg gtagatagtt tttttgagcc
127021 atattccaca gacaatatta gacatatggt aaaacgacta gatggaccat ctaataaata
127081 tcatatatat accgagaagt tattatctgt agacgagcct agaaatcaac ttattcttaa
127141 taccctggta gaagaattca agtcaggaac tattaatcgc attttagtta ttactaaact
127201 acgtgaacat atggtattat tctacaaacg attattagat cttttcggac cagaggttgt
127261 atttatagga gacgcccaaa atagacgtac tccagatatg gtcaaatcaa tcaaggaact
127321 aaatagattt atattcgtat ccaccttatt ttattccggt actggtttag atattcctag
```

FIG. 23 (CONT.)

```
127381 tttggattcg ttgttcattt gctcggcagt aatcaacaat atgcaaatag agcaattact
127441 agggagggta tgtcgagaaa cagaactatt agataggacg gtatatgtat ttcctaacac
127501 atccatcaaa gaaataaagt acatgatagg aaatttcatg caacgaatta ttagtctgtc
127561 tgtagataaa ctaggattta aacaagaaag ttatcggaaa catcaagaat ccgatcccac
127621 ttctgtatgt acaacatcct ccagagaaga acgtgtatta aatagaatat ttaactcgca
127681 aaatcgttaa gaagtttaag cgacgatccg catgctgcgc aggccagtgt attacccctc
127741 atagtattaa tataatccaa tgatactttt gtgatgtcgg aaatcttaac caatttagac
127801 tgacaggcag aacacgtcat gcaatcatca tcgtcatcga taactgtagt cttgggcttc
127861 tttttgcggc tcttcattcc ggaacgcaca ttggtgctat ccatttaggt agtaaaaaat
127921 aagtcagaat atgccctata acacgatcgt gcaaaacctg gtatatcgtc tctatcttta
127981 tcacaatata gtgtatcgac atctttatta ttattgacct cgtttatctt ggaacatgga
128041 atgggaacat ttttgttatc aacggccacc tttgccttaa ttccagatgt tgtaaaatta
128101 taactaaaca gtctatcatc gacacaaatg aaattcttgt ttagacgttt gtagtttacg
128161 tatgcggctc gttcgcgtct catttttca gatattgcag gtactataat attaaaaata
128221 agaatgaaat aacataggat taaaaataaa gttatcatga cttctagcgc tgatttaact
128281 aacttaaaag aattacttag tctgtacaaa agtttgaaat tttcagattc tgcggctata
128341 gaaaagtata attctttggt agaatgggga acatctactt actggaaaat aggcgtgcaa
128401 aaggtagcta atgtcgagac gtcaatatct gattattatg atgaggtaaa aaataaaccg
128461 tttaatattg atccgggcta ttacattttc ttaccggtat attttgggag cgtctttatt
128521 tattcgaagg gtaaaaatat ggtagaactt ggatctggaa actcttttca aataccagat
```

FIG. 23 (CONT.)

```
128581 gatatgcgaa gtgcgtgtaa caaagtatta gacagcgata acggaataga ctttctgaga
128641 tttgttttgt taaacaatag atggataatg gaagatgcta tatcaaaata tcagtctcca
128701 gttaatatat ttaaactagc tagtgagtac ggattaaaca tacccaaata tttagaaatt
128761 gaaatagagg aagacacatt atttgacgac gagttatact ctattataga acgctctttt
128821 gatgataaat ttccaaaaat atccatatcg tatattaagt tgggagaact taggcggcaa
128881 gttgtagact ttttcaaatt ctcgttcatg tatattgagt ccatcaaggt agatcgtata
128941 ggagataata tttttattcc tagcgttata acaaaatcag gaaaaaagat attagtaaaa
129001 gatgtagacc atttaatacg atctaaggtt agagaacata catttgtaaa agtaaaaaag
129061 aaaaacacat tttccatttt atacgactat gatgggaacg gaacagaaac tagaggagaa
129121 gtaataaaac gaattataga cactatagga cgagactatt atgttaacgg aaagtatttc
129181 tctaaggttg gtagtgcagg cttaaagcaa ttgactaata aattagatat taatgagtgc
129241 gcaactgtcg atgagttagt tgatgagatt aataaatccg gaactgtaaa acgaaaaata
129301 aaaaaccaat cagcatttga tttaagcaga gaatgtttgg gatatccaga agcagatttt
129361 ataacgttag ttaataacat gcggttcaaa atagaaaatt gtaaggttgt aaatttcaat
129421 attgaaaata ctaattgttt aaataacccg agtattgaaa ctatatatgg aaactttaac
129481 cagttcgtct caatctttaa tatcgtcacc gatgtcaaaa aaagattatt cgagtgaaat
129541 aatatgcgcc tttgatatag gtgcaaaaaa tcctgccaga actgttttag aagtcaagga
129601 taactccgtt agggtattgg atatatcaaa attagactgg agttctgatt gggaaaggcg
129661 catagctaaa gatttgtcac aatatgaata cactacagtt cttctagaac gtcagcctag
129721 aaggtcgccg tatgttaaat ttatctattt tattaaaggc tttttatatc atacatcggc
129781 tgccaaagtt atttgcgtct cgcctgtcat gtctggtaat tcatatagag atcgaaaaaa
```

FIG. 23 (CONT.)

```
129841 gagatcggtc gaagcatttc ttgattggat ggacacattc ggattgcgag actccgttcc
129901 ggatagacgc aaattagacg atgtagcgga tagtttcaat ttggctatga gatacgtatt
129961 agataaatgg aatactaatt atacacctta taataggtgt aaatctagaa attacataaa
130021 aaaaatgtaa taacgttagt aacgccatta tggataatct atttaccttt ctacatgaaa
130081 tagaagatag atatgccaga actattttta actttcatct aataagttgc gatgaaatag
130141 gagatatata tggtcttatg aaagaacgca tttcctcaga ggatatgttt gataatatag
130201 tatataataa agatatacat cctgccatta agaaactagt gtattgcgac atccaactta
130261 ctaaacacat tattaatcag aatacgtatc cggtatttaa cgattcttca caagtgaaat
130321 gttgtcatta tttcgacata aactcagata atagcaatat tagctctcgt acagtagaga
130381 tatttgagag ggaaaagtca tctcttgtat catatattaa aactaccaat aagaagagaa
130441 aggtcaatta cggcgaaata aagaaaactg ttcatggagg cactaatgca aattactttt
130501 ccggtaaaaa gtctgacgag tatctgagta ctacagttag atccaacatt aatcaacctt
130561 ggatcaaaac catttctaag agaatgagag tagatatcat taatcactct atagtaacgc
130621 gtggaaaaag ctctatatta caaactatag aaattatttt tactaataga acatgtgtga
130681 aaatattcaa ggattctact atgcacatta ttctatccaa ggacaaggat gaaaaggggt
130741 gtatacacat gattgacaaa ttattctatg tctattataa tttatttctg ttgttcgaag
130801 atatcatcca aaacgagtac tttaaagaag tagctaatgt tgtaaaccac gtacttacgg
130861 ctacggcatt agatgagaaa ttattcctaa ttaagaaaat ggctgaacac gatgtttatg
130921 gagttagcaa tttcaaaata gggatgttta acctgacatt tattaagtcg ttggatcata
130981 ccgtttcccc ctctctgtta gatgaggata gcaaaataaa gtttttaag gggaaaagc
```

FIG. 23 (CONT.)

131041 tcaatattgt agcattacga tctctggagg attgtataaa ttacgtgact aaatccgaga
131101 atatgataga aatgatgaag gaaagatcga ctattttaaa tagcatagat atagaaacgg
131161 aatcggtaga tcgtctaaaa gaattgcttc taaaatgaaa aaaaacactg attcagaaat
131221 ggatcaacga ctagggtata agtttttggt gcctgatcct aaagccggag tttttttatag
131281 accgttacat ttccaatatg tatcgtattc taattttata ttgcatcgat tgcatgaaat
131341 cttgaccgtc aagcggccac tcttatcgtt taagaataat acagaacgaa ttatgataga
131401 aattagcaat gttaaagtga ctcctccaga ttactcacct ataatcgcga gtattaaagg
131461 taagagttat gatgcattag ccacgttcac tgtaaatatc tttaaagagg taatgaccaa
131521 agagggtata tccatcacta aaataagtag ttatgaggga aaagattctc atttgataaa
131581 aattccgcta ctaataggat acgggaataa aaatccactt gatacagcca agtatcttgt
131641 tcctaatgtc ataggtggag tctttatcaa taaacaatct gtcgaaaaag taggaattaa
131701 tctagtagaa aagattacaa catggccaaa atttagggtt gttaagccaa actcattcac
131761 tttctcgttt tcctccgtat cccctcctaa tgtattaccg acaagatatc gccattacaa
131821 gatatctctg gatatatcac aattggaagc gttgaatata tcatcgacaa agacatttat
131881 aacggtcaat attgttttgc tgtctcaata tttatctaga gtgagtctag aattcattag
131941 acgtagttta tcatacgata tgcctccaga agttgtctat ctagtaaacg cgataataga
132001 tagtgctaaa cgaattactg aatctattac tgactttaat attgatacat acattaatga
132061 cctggtggaa gctgaacaca ttaaacaaaa atctcagtta acgatcaacg agttcaaata
132121 tgaaatgctg cataactttt tacctcatat gaactataca cccgatcaac taaaggatt
132181 ttatatgata tctttactaa gaaagtttct ctactgtatc taccacactt ctagatatcc

FIG. 23 (CONT.)

132241 agatagagat tcgatggttt gtcatcgcat cctaacgtac ggcaaatatt ttgagacgtt
132301 ggcacatgat gaattagaga attacatagg caacatccga aacgatatca tgaacaatca
132361 caagaacaga ggcacttacg cggtaaacat tcatgtacta acaactcccg gacttaatca
132421 cgcgttttct agcttattga gtggaaagtt caaaaagtca gacggtagtt atcgaacaca
132481 tcctcactat tcatggatgc agaatatttc tattcctagg agtgttggat tttatccgga
132541 tcaagtaaag atttcaaaga tgttttctgt cagaaaatac catccaagtc aatatcttta
132601 cttttgttca tcggacgttc cggaaagagg tcctcaggta ggtttagtat ctcaattgtc
132661 tgtcttgagt tccattacaa atatactaac gtctgagtat ttggatttgg aaaagaaaat
132721 ttgtgagtat atcagatcat attataaaga tgatataagt tactttgaaa caggatttcc
132781 aatcactata gaaaatgctc tagtcgcatc tcttaatcca aatatgatat gtgattttgt
132841 aactgacttt agacgtagaa aacggatggg attcttcggt aacttggagg taggtattac
132901 tttagttagg gatcacatga atgaaattcg cattaatatt ggagcgggaa gattagtcag
132961 accattcttg gttgtggata acggagagct catgatggat gtgtgtccgg agttagaaag
133021 cagattagac gacatgacat tctctgacat tcagaaagag tttccgcatg tcatcgaaat
133081 ggtagatata gaacaattta cttttagtaa cgtatgtgaa tcggttcaaa aatttagaat
133141 gatgtcaaag gatgaaagaa agcaatacga tttatgtgac tttcctgccg aatttagaga
133201 tggatatgtg gcatcttcat tagtgggaat caatcacaat tctggaccca gagctattct
133261 tggatgtgct caagctaaac aagctatctc ttgtctgagt tcggatatac gaaataaaat
133321 agacaatgga attcatttga tgtatccaga gaggccaatc gtgattagta aggctttaga
133381 aacttcaaag attgcggcta attgcttcgg ccaacatgtt actatagcat taatgtcgta
133441 caaaggtatc aatcaagagg atggaattat catcaaaaaa caatttattc agagaggcgg

FIG. 23 (CONT.)

133501 tctcgatata gttaccgcaa agaaacatca agtagaaatt ccgttggaaa actttaataa
133561 caaagaaaga gataggtcta acgcctattc aaaattagaa agtaatggat tagttagact
133621 gaatgctttc ttggaatccg gagacgctat ggcacgaaat atctcatcaa gaactcttga
133681 agatgatttt gctagagata atcagattag cttcgatgtt tccgagaaat ataccgatat
133741 gtacaaatct cgcgttgaac gagtacaagt agaacttact gacaaagtta aggtacgagt
133801 attaaccatg aaagaaagaa gacccattct aggagataaa tttaccacta gaacgagtca
133861 aaagggaaca gtcgcgtatg tcgcggatga aacggaactt ccatacgacg aaaatggtat
133921 cacaccagat gtcattatta attctacatc catcttctct agaaaaacta tatctatgtt
133981 gatagaggtt attttaacag ccgcatattc tgctaagccg tacaacaata agggagaaaa
134041 ccgacctgtc tgttttccta gtagtaacga aacatccatc gatacatata tgcaattcgc
134101 taaacaatgt tatgagcatt caaatccgaa attgtccgat gaagaattat cggataaaat
134161 cttttgtgaa aagattctct atgatcctga aacggataag ccttatgcat ccaaagtatt
134221 ttttggacca atttattact tgcgtctgag gcatttaact caggacaagg caaccgttag
134281 atgtagaggt aaaaagacga agctcattag acaggcgaat gagggacgaa aacgtggagg
134341 aggtatcaag ttcggagaaa tggagagaga ctgtttaata gcgcatggcg cagccaatac
134401 tattacagaa gttttaaaag actcagaaga ggattatcaa gatgtgtatg tttgtgaaaa
134461 ttgtggagac atagcagcac aaatcaaggg tattaataca tgtcttagat gttcaaaact
134521 taatctctct cctctcttaa caaaaattga taccacgcac gtatctaaag tatttcttac
134581 tcaaatgaac gccagaggcg taaaagtcaa attagatttc gaacgaaggc ctccttcgtt
134641 ttataaacca ttagataaag ttgatctcaa gccgtctttt ctggtgtaat attctagttt

FIG. 23 (CONT.)

```
134701 ggtagtagat acatatcaat atcatcaaat tcgagatccg aattataaaa tgggcgtgga
134761 ttgttaacta tagaatcgga cgtctgatat tcgaaaatct gtggagtttt aggttttggt
134821 ggaggtgtaa ctgctacttg ggatactgaa gtctgatatt cagaaagctg ggggatgttc
134881 tggttcgaca tccaccgatg gtgtcacatc actaatcggt tcggtaacgt ctgtggatgg
134941 aggtgctact tctacagaac ctgtagcctc agttgtcaac ggagatacat ttttaatgcg
135001 aggaaatgta taatttggta atggtttctc atgtggatct gaagaagagg taagatatct
135061 actagaaaga taccgatcac gttctagttc tcttttgtag aacttaactt tttctttctc
135121 agcatctagt tgatattcca acctcttcac gttactacgt tcagattcca attcacgttc
135181 gcatgggtta cctccgcagt ttttacgagc gatttcacgt tcagccttca tgcgtctctc
135241 cttctctcta tcgagtttat cagagcagtc tttctgaagg cgatcgaact ccataaattt
135301 ctccaacgct ttgattgttt ccatagattt ccgaagttca gcttttagga ctgtgattct
135361 ttttctttcg aattcacagc tggatgtgca accgtttcca ttaccgccat ctctaagttt
135421 cttttctaga tcggcaacat ttcatcccca tgccttttac attcctcgag tctactgtcg
135481 tcgaaatatc gttccagctc cttttcgaca tcaataactt tagcacgttg tctctcaagc
135541 tctcttttgt agttatctga ttccctggca cgtttaagat cttcatgcaa ttgagtcagc
135601 tcttaacaca atctcttgct tcttcgtcat agtacttaca atcactatgg gatccattgt
135661 taccacgtct acactcggcg agctcgcgtt taagagattc aatttcccgt ttgtattggt
135721 ccatgtttcc attgctacca ccattagatt tacaggctgc tagttgtcgt tcgagatcag
135781 aaatacgggt tttcttggaa ttgatttcgt cgatgtactt ggcatcgaaa cacttattaa
135841 gttctttttc caattctacg attttatttc tttcgcgagt caattccctc ctgtagtaac
```

FIG. 23 (CONT.)

135901 tatctgtttt gtcagattca cgctctctac gtagactttc ttgcaagtta ctaatttgtt
135961 ccctagcacg tccgagttta gttttatatg ctgaatagag ttctgattca tcctttgagc
136021 agatctctag cgatcgttta agattcctga ttctagtctt tagcctattt acctcctcag
136081 aagatgttcc gttaccgttg cgtttacact cgttaagctg tctatcaaga tccatgattc
136141 tatctctaag acgttgcatc tctctttcca tatcagcatt gctttcatta ttacgtctgc
136201 agtcactcaa ctgtctttca atatctgaga ttctatctct aagacgtcgc atctctctct
136261 gtttcggcat tggtttcatt attacgtcta cagtcgttca actgtctttc aagatctgat
136321 attctagatt ggagtctgct aatctctgta gcattttcac ggcattcact cagttgtctt
136381 tcaagatctg agattttaga ttggagtctg ctaatctctg taagatttcc tcctccgctc
136441 tcgatgcagt cggtcaactt attctctagt tctctaatac gcgaacgcag tgcatcaact
136501 tcttgcgtgt cttcctggtt gcgtgtacat tcatcgagtc tagattcgag atctctaacg
136561 cgtcgtcgtt cttcctcaag ttctctgcgt actacagaaa gcgtgtccct atcttgttga
136621 tatttagcaa tttctgattc tagagtactg atttgcttta cgtagttact aatagttgtc
136681 ttggccttat caagatcctc cttgtatttg tcgcattcct tgatatccct acgaagtctg
136741 gacagttccc attcgacatt acgacgttta tcgatttcag ctcggagatc gtcatcgcgt
136801 tgttttagcc acatacgact gagttcaagt tctcgttgac aagatccatc tacttttcca
136861 ttcctaatag tatccagttc cttttctagt tctgaacgca tttctcgttc cctatcaagc
136921 gattctctca attctcggat agtcttctta tcaatttcta ataaatctga accatcatct
136981 gtcccatttt gaatatccct gtgttctttg atctcttttg taagtcggtc gattctttcg
137041 gttttataaa cagaatccct ttccaaagtc ctaatcttac tgagtttatc actaagttct
137101 gcattcaatt cggtgagttt tctcttggct tcttccaact ctgttttaaa ctctccacta

FIG. 23 (CONT.)

137161 tttccgcatt cttcctcgca tttatctaac cattcaatta gtttattaat aactagttgg
137221 taatcagcga ttcctatagc cgttcttgta attgtgggaa cataattagg atcttctaat
137281 ggattgtatg gcttgatagc atcatcttta tcattattag ggggatggac aaccttaatt
137341 ggttggtcct catctcctcc agtagcgtgt ggttcttcaa taccagtgtt agtaataggc
137401 ttaggcaaat gcttgtcgta cgcgggcact tcctcatcca tcaagtattt ataatcgggt
137461 tctacgtctg aatattcttt tctaagagac gcgacttcgg gagttagtag aagaactctg
137521 tttctgtatc tatcaacgct ggaatcaata ctcaagttaa ggatagcgaa tacctcatcg
137581 tcatcatccg tatcttctga aacaccatca tatgacattt catgaagtct aacgtattga
137641 taaatagaat cagatttagt attaaacaga tccttaacct ttttagtaaa cgcatatgta
137701 tattttagat ctccagattt cataatatga tcacatgcct taaatgtcag tgcttccatg
137761 atataatctg gaacactaat gggtgacgaa aaagatacag caccatatgc tacgttgata
137821 aataaatctg aaccactaag tagataatga ttaatgttaa ggaagaggaa atattcagta
137881 tatagatatg ccttagcatc atatcttgta ctaaacacgc taaacagttt attgatgtga
137941 tcaatttcca acagaataat tagagcagcg ggaataccaa caaacatatt accacatccg
138001 tattttctat gaatatcaca tatcatgtta aaaaatcttg atagaagagc gaatatctcg
138061 tctgacttaa tgagtcgtag ttcagcagca acataagtca taactgtaaa tagaacatac
138121 tttcctgtag tgttgattct agactccaca tcaacaccat tattaaaaat agttttatat
138181 acatctttaa tctgctctcc gttaatcgtc gaacgttcta gtatacggaa acactttgat
138241 ttcttatctg tagttaatga cttagtgata tcacgaagaa tattacgaat tacatttctt
138301 gtttttcttg agagacctga ttcagaactc aactcatcgt tccatagttt ttttacctca

FIG. 23 (CONT.)

138361 gtggcgaaat ctttggagtg cttggtacat ttttcaataa ggttcgtgac ctccatttat
138421 tataaaaaat tttattcaaa acttaactac aatcgggtaa ttataaaatc gtagatctcc
138481 catgtggtgg aatactacca tctatcgcat gtggatggac agtaggtaat ggccatggga
138541 acagtaatgt ttgcatattt atctttcttg ccagtattac tgcatattgt cccaatgttt
138601 cgatgtgatg ttctaaccta tcaactgccg ctgtatcaca acaatagtgt ccgatgaaat
138661 taagattatg atccaatgtg tttaatatat gattatcaag tcttatacga tccgcgtctt
138721 ttttgacagg atcaggttct tctacaggaa gaagtttcgg cctcttatga tattcatgtc
138781 tgggaaacgg tggtctaggg tgaggctccg gtatcggagt gggttttgga ttataatcat
138841 catcgtctat gacatcatct tcgacttcga tatttatttt gctatcttga tgatgtcctg
138901 tatcagttgc attttcagca ctcgactgaa tattagcgca ttcattgtct attattacca
138961 tatttctaaa cccaaaatgt atgtgttgaa catcagtact atcgttgatg agtcttatag
139021 catgaattcg cttatcgtta tcgggtttat cttctgtcac cttagcaatt ccttttttat
139081 taaactctac ataatcatat ccatttctat tgtttgttct aatataaacg agtatagcat
139141 cattgctaaa tttttcaata gtatcgaaaa cagaatatcc taaaccatat aatatatatt
139201 cagggacact caaactaaat gtccaggatt ctcctaaata cgtaaacttt aatagtgcga
139261 aatcattcaa aaatctacca cttatagata gatagtacat aaatgcgtat agtagtctac
139321 ctatctcttt attatgaaaa ccggcattac gatcatatat gtcgtgatat acctgtgatc
139381 cgtttacgtt aaaccataaa tacatgggtg atcctataaa catgaattta tttctaattc
139441 tcagagctat agttaattga ccgtgtaata tttgcttaca tgcatacttg atacgctcat
139501 taataaaatt tttatcattg ctcgttatct cagaatcgta tatataagga gtaccatcgt

FIG. 23 (CONT.)

```
139561 gattcttacc agatattata caaaatacta tatataaaat atattgacca acgttagtaa
139621 tcatataaat gtttaacgtt ttaaattttg tattcaatga tccattatca tacgctagca
139681 tggtcttatg atattcattc tttaaaatat aatattgtgt tagccattgc attggggctc
139741 ctaatggaga tttttattc tcatccattt taggataggc tttcataaag tccctaataa
139801 cttcgtgaat aatgtttcta tgttttctac tgatgcatgt atttgcttcg atttttttat
139861 cccatgtttc atctatcata gatttaaacg cagtaatgct cgcaacatta acatcttgaa
139921 ccgttggtac aattccgttc cataaattta taatgttcgc catttatata actcattttt
139981 tgaatatact tttaattaac aaaagagtta agttactcat atgggcgccg tccagtctga
140041 acatcaatct ttttagccag agatatcata gccgctctta gagtttcagc gtgattttcc
140101 aacctaaata gaacttcatc gttgcgttta caacactttt ctatttgttc aaactttgtt
140161 gttacattag taatcttttt ttccaaatta gttagccgtt gtttgagagt ttcctcattg
140221 tcgtcttcat cggctttaac aattgcttcg cgtttagcct ctggcttttt agcagccttt
140281 gtagaaaaaa attcagttgc tggaattgca agatcgtcat ctccggggaa aagagttccg
140341 tccatttaaa gtacagattt tagaaactga cactctgcgt tatttatatt tggtacaaca
140401 catggattat aaatatcgat gttaataaca tcagaaaatg taaagtctat acattgttgc
140461 atcgtgttaa attttctaat ggatctagta ttattgggtc caacttctgc ctgaaatcca
140521 aatatggaag cggatacaaa accgtttcct ggataaacca cacatctcca cttttgcttt
140581 acatcagaaa ttgtgtcgtt gacatcttga actctcctat ctaatgccgg tgttccacct
140641 atagattttg aatattcgaa tgctgcatga gtagcattaa attccttaat attgccataa
140701 ttttcatata ttgagtaacc ctggataaaa agtaaacaca ccgcagccgt cgctaccaca
140761 ataaaaaaaa ttgatagaga gttcatttat aatctattag aagctgacaa aattttttta
```

FIG. 23 (CONT.)

140821 cacgcatcag acaatgcttt aataaatagt tcaacatcta cttttgtcat atcgaaccga
140881 tggtatgatt ctaacctaga attacatccg aaaaagttga ctatgttcat agtcattaag
140941 tcattaacaa acaacattcc agactctgga ttataagacg atactgtttc gtcacaatta
141001 cctaccttaa tcatgtgatt atgaatattg gctattagag caccttctaa gaaatctata
141061 atatctttga aacacgattt aaaatcaaac cacgaatata cttctacgaa gaaagttagt
141121 ttacccatag gagaaataac tataaatgga gatctaaata caaaatccgg atctatgata
141181 gttttaacat tattatattc tctattaaat acctccacat ctaaaaatgt taattttgaa
141241 actatgtctt cgtttattac cgtacctgaa ctaaacgcta taagctctat tgtttgagaa
141301 ctctttaaac gatattcttg aaatacatgt aacaaagttt cctttaactc ggtcggttta
141361 tctaccatag ttacagaatt tgtatcctta tctataatat aataatcaaa atcgtataaa
141421 gttatataat tatcgcgttc agattgggat cttttcaaat agactaaaaa ccccatttct
141481 ctagtaagta tcttatgtat atgtttgtaa aatatcttca tggtgggaat atgctctacc
141541 gcagttagcc attcctcatt gacagcggta gatgtattag acaaaactat tccaatgttt
141601 aacaagggcc attttacgag attattaaat ccttgtttga taaatgtagc caatgagggt
141661 tcgagttcaa cgacgattga attctcttcc cgcggatgct gcatgatgaa cgacgggatg
141721 ttgttcgatt gatttggaat tctttttcga ctttttgttt atattaaata ttttaaaatt
141781 tatagcggat agcaattcat gtaccacgga taatgtagac gcgtattgcg catcgatatc
141841 tttattatta gataaattta tcaataaatg tgagaagttt gcctcgttaa ggtcttccat
141901 ttaaatatta tataaacatt tgtgtttgta tcttattcgt cttttatgga atagtttttt
141961 actagtaaag ctgcaattac acactttgtc cgtaaaacat aaatataaac accagctttt

FIG. 23 (CONT.)

142021 atcaatcgtt ccaaaaagtc gacggcggac atttttaaca tggcatctat tttaaataca
142081 cttaggtttt tggaaaaaac atcattttat aattgtaacg attcaataac taaagaaaag
142141 attaagatta aacataaggg aatgtcattt gtattttata agccaaagca ttctaccgtt
142201 gttaaatact tgtctggagg aggtatatat catgatgatt tggttgtatt ggggaaggta
142261 acaattaata atctaaagat gatgctattt tacatggatt tatcatatca tggagtgaca
142321 agtagtggag caatttacaa attgggatcg tctatcgata gactttctct aaataggact
142381 attgttacaa aagttaataa ttatgatgat acatttttg acgacgatga ttgatcgcta
142441 ttgcacaatt ttgttttttt actttctaat atagcgttta gattcttttt catgtgcgaa
142501 tattgattta ctaaaatatc gatgtttaac ttttgttcta tgacgtcctt atcagcggta
142561 tcggtacata tacgtaattc accttcacaa aatacggagt cttcgataat aatagccaat
142621 cgattattgg atctagctgt ctgtatcata ttcaacatgt ttaatatatc ctttcgtttc
142681 ccctttacag gcatcgatcg tagcatattt tccgcgtctg agatggaaat gttaaaacta
142741 caaaaatgcg taatgttagc ccgtcctaat attggtacgt gtctataagt ttggcatagt
142801 agaataatag acgtgtttaa atgccttcca aagtttaaga attctattag agtattgcat
142861 tttgatagtt tatcacctac atcatcaaaa ataagtaaaa agtgtgctga tttttatga
142921 ttttgtgcga cagcaataca tttttctatg ttacttttag ttcgtatcag attatattct
142981 agagattcct gactactaac gaaattaata tgatttggcc aaatgtatcc atcataatct
143041 gggttataaa cgggtgtaaa caagaatata tgtttatatt ttttaactag tgtagaaaac
143101 agagatagta aatagatagt tttccagat ccagatcctc ccgttaaaac cattctaaac
143161 ggcattttta ataaatttc tcttgaaaat tgtttttctt ggaaacaatt cataattata

FIG. 23 (CONT.)

143221 tttacagtta ctaaattaat ttgataataa atcaaaatat ggaaaactaa ggtcgttagt
143281 agggaggaga acaaagaagg cacatcgtga cataaataac atttattatc atgatgacac
143341 cagaaaacga cgaagagcag acatctgtgt tctccgctac tgtttacgga gacaaaattc
143401 aaggaaagaa taaacgcaaa cgcgtgattg gtctatgtat tagaatatct atggttattt
143461 cactactatc tatgattacc atgtccgcgt ttctcatagt gcgcctaaat caatgcatgt
143521 ctgctaacga ggctgctatt actgacgccg ctgttgccgt tgctgctgca tcatctactc
143581 atagaaaggt tgcgtctagc actacacaat atgatcacaa agaaagctgt aatggtttat
143641 attaccaggg ttcttgttat atattacatt cagactacca gttattctcg gatgctaaag
143701 caaattgcac tgcggaatca tcaacactac ccaataaatc cgatgtcttg attacctggc
143761 tcattgatta tgttgaggat acatggggat ctgatggtaa tccaattaca aaaactacat
143821 ccgattatca agattctgat gtatcacaag aagttagaaa gtatttttgt gttaaaacaa
143881 tgaactaata tttatttttg tacattaata aatgaaatcg cttaatagac aaactgtaag
143941 taggtttaag aagttgtcgg tgccggccgc tataatgatg atactctcaa ccattattag
144001 tggcatagga acatttctgc attacaaaga agaactgatg cctagtgctt gcgccaatgg
144061 atggatacaa tacgataaac attgttattt agatactaac attaaaatgt ctacagataa
144121 tgcggtttat cagtgtcgta aattacgagc cagattgcct agaccggata ctagacatct
144181 gagagtattg tttagtattt tttataaaga ttattgggta agtttaaaaa agaccaatga
144241 taaatggtta gatattaata atgataaaga tatagatatt agtaaattaa caaattttaa
144301 acaactaaac agtacgacgg atgctgaagc gtgttatata tacaagtctg gaaaactggt
144361 taaaacagta tgtaaaagta ctcaatctgt actatgtgtt aaaaaattct acaagtgaca
144421 acaaaaaatg aattaataat aagtcgttaa cgtacgccgc catggacgcc gcgtttgtta

FIG. 23 (CONT.)

```
144481 ttactccaat gggtgtgttg actataacag atacattgta tgatgatctc gatatctcaa
144541 tcatggactt tataggacca tacattatag gtaacataaa aactgtccaa atagatgtac
144601 gggatataaa atattccgac atgcaaaaat gctactttag ctataagggt aaaatagttc
144661 ctcaggattc taatgatttg gctagattca acatttatag catttgtgcc gcatacagat
144721 caaaaaatac catcatcata gcatgcgact atgatatcat gttagatata gaagataaac
144781 atcagccatt ttatctattc ccatctattg atgtttttaa cgctacaatc atagaagcgt
144841 ataacctgta tacagctgga gattatcatc taatcatcaa tccttcagat aatctgaaaa
144901 tgaaattgtt gtttaattct tcattctgca tatcagacgg caatggatgg atcataattg
144961 atgggaaatg caatagtaat tttttatcat aaaagttgta aagtaaataa taaaacaata
145021 aatattgaac tagtagtacg tatattgagc aatcagaaat gatgctggta cctcttatca
145081 cggtgaccgt agttgcggga acaatattag tatgttatat attatatatt tgtaggaaaa
145141 agatacgtac tgtctataat gacaataaaa ttatcatgac aaaattaaaa aagataaaga
145201 gttctaattc cagcaaatct agtaaatcaa ctgatagcga atcagactgg gaggatcact
145261 gtagtgctat ggaacaaaac aatgacgtag ataatatttc taggaatgag atattggacg
145321 atgatagctt cgctggtagt ttaatatggg ataacgaatc caatgtcatg gcgcctagca
145381 cagaacacat ttacgatagt gttgctggaa gcacgctgct aataaataat gatcgtaatg
145441 aacagactat ttatcagaac actacagtag taattaatga gacggagact gttgaagtac
145501 ttaatgaaga taccaaacag aatcctaact attcatccaa tcctttcgta aattataata
145561 aaaccagtat ttgtagcaag tcaaatccgt tcattacaga actcaacaat aaatttagtg
145621 agaataatcc gtttagacga gcacatagcg atgattatct taataagcaa gaacaagatc
```

FIG. 23 (CONT.)

```
145681 atgaacacga tgatatagaa tcatcggtcg tatcattggt gtgattagtt tcctttttat
145741 aaaattgaag taatatttag tattattgct gccgtcacgt tgtacaaatg gagatattcc
145801 ctgtattcgg catttctaaa attagcaatt ttattgctaa taatgactgt agatattata
145861 tagatacaga acatcaaaaa attatatctg atgagatcaa tagacagatg gatgaaacgg
145921 tacttcttac caacatctta agcgtagaag ttgtaaatga caatgagatg taccatctta
145981 ttccccatag actatcgact attatactct gtattagttc tgtcggagga tgtgttatct
146041 ctatagataa tgacatcaat gacaaaaata ttctaacatt tcccattgat catgctgtaa
146101 tcatatcccc actgagtaaa tgtgtcgtag ttagcaaggg tcctacaacc atattggttg
146161 ttaaagcgga tatacccagc aaacgattgg taacatcgtt tacaaacgac atactgtatg
146221 taaacaatct gtcactgatt aattatttgc cgttgtctgt attcattatt agacgagtca
146281 ccgactattt ggatagacac atatgcgatc agatatttgc gaataataag tggtattcca
146341 ttataaccat cgacgataag caatatccta ttccatcaaa ctgtataggt atgtcctctg
146401 ccaagtacat aaattctagc atcgagcaag atactttaat acatgtttgt aacctcgagc
146461 atccattcga cttagtatac aaaaaaatgc agtcgtacaa ttctgtacct atcaaggaac
146521 aaatattgta cggtagaatt gataatataa atatgagcat tagtatttct gtggattaat
146581 agatttctag tatggggatc attaatcatc tctaatctct aaatacctca taaaacgaaa
146641 aaaaagctat tatcaaatac tgtacggaat ggattcattc tcttctcttt ttatgaaact
146701 ctgttgtata tctactgata aaactggaag caaaaaatct gataaaaaga ataagaataa
146761 gatcaaggat tatatggaac acgattatta taaaataaca atagttcctg gttcctcttc
146821 cacgtctact agctcgtggt attatacaca tgcctagtaa tagtctcttt gcgttgacgg
```

FIG. 23 (CONT.)

```
146881 aaagcagact agaaataaca ggctaaaatg ttcagacacc ataatagttc ccaacccaga
146941 taataacaga gtaccatcaa cacattcctt taaactcaat cccaaaccca aaaccgttaa
147001 aatgtatccg gccaattgat agtagataat gaggtgtaca gcgcatgata atttacacag
147061 taaccaaaat gaaaatactt tagtaattat aagaaatata gatggtaacg tcatcatcaa
147121 caatccaata atatgccgga gagtaaacat tgacggataa aacaaaaatg ctccgcataa
147181 ctctatcatg gcaataacac aaccaaatac ttgtaagatt cctaaattag tagaaaatac
147241 aacggatatc gatgtataag tgatctcgag aaataataag aataaagtaa tgcccgtaaa
147301 gataaacatc aacattgttt ggtaatcatt aaaccaatta gtatgaagtt gaactaattt
147361 cacagtagat tttattccag tgttatcctc gcatgtatac gtacctggta agatatcttt
147421 atattctata atcaatgaga catcactatc cgataacgaa tgaagtctag cactagtatg
147481 ccatttactt aatatggtcg tcttggaagt tttattataa gttaaaatat catggttgtc
147541 caatttccat ctaatatact ttgtcggatt atctatagta cacggaataa tgatggtatt
147601 attacatgct gtatactcta tagtctttgt agatgttata atcataaaag tacagaggta
147661 tatcaacgat attctaactc ttgacatttt ttatttattt aaaatgatac ctttgttatt
147721 tattttattc tattttgcta acggtatcga atggcataag tttgaaacga gtgaagaaat
147781 aatttctact tacttattag acgacgtatt atacacgggt gttaatgggg cggtatacac
147841 attttcaaat aataaactaa acaaaactgg tttagctaat actaattata tcacaacatc
147901 tataaaagta gaggatgcgg ataaggatac attagtatgc ggaaccaata acggaaatcc
147961 caaatgttgg aaaatagacg gttcagacga cccaaaacat agaggtagag gatacgctcc
148021 ttatcaaaat agcaaagtaa cgataatcag tcacaacgga tgtgtactat ctgacataaa
148081 catatcaaaa gaaggaatta aacgatggag aagatttgac ggaccatgtg gttatgattt
```

FIG. 23 (CONT.)

148141 atacacggcg gataacgtaa ttccaaaaga tggtttacga ggagcattcg tcgataaaga
148201 tggtacttat gacaaagttt acattctttt cactgatact atcggctcaa agagaattgt
148261 caaaattccg tatatagcac aaatgtgcct aaacgacgaa ggtggtccat catcattgtc
148321 tagtcataga tggtcgacgt ttctcaaagt cgaattagaa tgtgatatcg acggaagaag
148381 ttatagacaa attattcatt ctagaactat aaaaacagat aatgatacga tactatatgt
148441 attcttcgat agtccgcatt atgtacctat tctatgaata ccattaaaca atctttttct
148501 acgtcaaaat tggaaggata tacaaagcaa ttgccgtctc cagctcctgg tatatgtcta
148561 ccagctggaa aagttgttcc acataccacg tttgaagtca tagaaaaata taatgtacta
148621 gatgatatta taaagccttt atctaaccaa cctatcttcg aaggaccgtc tggtgttaaa
148681 tggttcgata taaaggagaa ggaaaatgaa catcgggaat atagaatata cttcataaaa
148741 gaaaattcta tatattcgtt cgatacaaaa tctaaacaaa ctcgtagctc gcaagtcgat
148801 gcgcgactat tttcagtaat ggtaacttcg aaaccgttat ttatagcaga tatagggata
148861 ggagtaggaa tgccacaaat gaaaaaaata cttaaaatgt aatcttaatc gagtacacca
148921 cacgacaatg aacaaacata agacagatta tgctggttat gcttgctgcg taatatgcgg
148981 tctaattgtt ggaattattt ttacagcgac actattaaaa gttgtagaac gtaaattagt
149041 tcatacacca tcaatagata aaacgataaa agatgcatat attagagaag attgtcctac
149101 tgactggata agctataata ataaatgtat ccatttatct actgatcgaa aaacctggga
149161 ggaaggacgt aatgcatgca aagctctaaa tccaaattcg gatctaatta agatagagac
149221 tccaaacgag ttaagttttt taagaagcat tagacgcgga tattgggtag gagaatccga
149281 aatattaaac cagacaaccc catataattt tatagctaag aatgccacga agaatggaac

FIG. 23 (CONT.)

149341 taaaaaacgg aaatatattt gtagcacaac gaatactccc aaactgcatt cgtgttacac
149401 tatataacaa ttacactaca tttttatcat accactactt cggttagatg ttttagaaaa
149461 aaataaatat cgccgtaccg ttcttgtttt tataaaaata acaattaaca attatcaaat
149521 tttttcttta atattttacg tggttgacca ttcttggtgg taaaataatc tcttagtgtt
149581 ggaatggaat gctgtttaat gtttccacac tcatcgtata ttttgacgta tgtagtcaca
149641 tcgtttacgc aatagtcaga ctgtagttct atcatgcttc ctacattaga aggaggaaca
149701 gttttaaagt ctcttggttt taatctatta ccgttagttt tcatgaaatc ctttgtttta
149761 tccacttcac attttaaata aatgtccact atacattctt ctgttaattt tactagatcg
149821 tcatgggtca tagaatttat aggttccgta gtccatggat ccaaactagc aaacttcgcg
149881 tatacggtat cgcgattagt gtatacacca actgtatgaa aattaagaaa acagtttaat
149941 agatcaacag aaatatttaa tcctccgttt gatacagatg caccatattt atggatttg
150001 gattcacacg ttgtttgtct gaggggttcg tctagcgttg cttctacata aacttctatt
150061 cccatatatt ctttattgtc agaatcgcat accgatttat catcatacac tgtttgaaaa
150121 ctaaatggta tacacatcaa aataacaaat actaacgagt acattctgca atattgttat
150181 cgtaattgga aaaatagtgt tcgagtgagt tggattatgt gagtattgga ttgtatattt
150241 tattttatat tttgtaataa gaataaaatg ctaatgtcaa gtttattcca atagatgtct
150301 tattaaaaac atatataata aataacaatg gctgaatggc ataaaattat cgaggatatc
150361 tcaaaaaata ataagttcga ggatgccgcc atcgttgatt acaagactac aaagaatgtt
150421 ctagctgcta ttcctaacag aacatttgcc aagattaatc cgggtgaaat tattcctctc
150481 atcactaatc gtaatattct aaaacctctt attggtcaga aatattgtat tgtatatact

FIG. 23 (CONT.)

150541 aactctctaa tggatgagaa cacgtatgct atggagttgc ttactgggta cgcccctgta
150601 tctccgatcg ttatagcgag aactcatacc gcacttatat ttttgatggg taagccaaca
150661 acatccagac gtgacgtgta tagaacgtgt agagatcacg ctacccgtgt acgcgcaact
150721 ggtaattaaa ataaaaagta atattcatat gtagtgtcaa ttttaaatga tgatgatgaa
150781 atggataata tccatattga cgatgtcaat aatgccggta ttggcataca gctcatcgat
150841 ttttagattt cattcagagg atgtggaatt atgttatggg catttgtatt ttgataggat
150901 ctataatgta gtaaatataa aatataatcc gcatattcca tatagatata attttattaa
150961 tcgcacgtta accgtagatg aactagacga taatgtcttt tttacacatg gttatttttt
151021 aaaacacaaa tatggttcac ttaatcctag tttgattgtc tcattatcag gaaacttaaa
151081 atataatgat atacaatgct cagtaaatgt atcgtgtctc attaaaaatt tggcaacgag
151141 tacatctact atattaacat ctaaacataa gacttattct ctacatcggt ccacgtgtat
151201 tactataata ggatacgatt ctattatatg gtataaagat ataaatgaca agtataatgg
151261 catctatgat tttactgcaa tatgtatgct aatagcgtct acattgatag tgaccatata
151321 cgtgtttaaa aaaataaaaa tgaactctta attatgctat gctattagaa atggataaaa
151381 tcaaaattac ggttgattca aaaattggta atgttgttac catatcgtat aacttggaaa
151441 agataactat tgatgtcaca cctaaaaaga aaaaagaaaa ggatgtatta ttagcgcaat
151501 cagttgctgt cgaagaggca aaagatgtca aggtagaaga aaaaaatatt atcgatattg
151561 aagatgacga tgatatggat gtagaaagcg cataatacga tctataaaaa taagtatata
151621 aatacttttt atttactgta ctcttactgt gtagtggtga taccctactc gattattttt
151681 ttaaaaaaat acttattctg attcttctag ccatttccgt gttcgttcga atgccacatc
151741 gacgttaaag ataggggagt agttgaaatc tagttctgca ttgttggtac gcacctcaaa

FIG. 23 (CONT.)

151801 tgtagtgttg gatatcttca acgtatagtt gttgagtagt gatggttttc taaatagaat
151861 tctcttcata tcattcttgc acgcgtacat ttttagcatc catcttggaa ttctagatcc
151921 ttgttctatt cccaatggtt tcatcaatag aagattaaac atatcgtacg aacacgatgg
151981 agagtaatcg tagcaaaagt aagcatttcc tttaatctca gatcccggat actggatata
152041 ttttgcagcc aacacgtgca tccatgcaac atttcctaca tatacccggc tatgcaccgc
152101 gtcatcatcg actgtacgat acataatgtt accgtgttgc ttacattgct cgtaaaagac
152161 tttcgtcaat ttgtctcctt ctccgtaaat tccagtgggt cttaggcaac aagtatacaa
152221 ttttgctcca ttcatgatta cggaattatt ggctttcata accagttgct cggccatacg
152281 tttacttttt gcgtatacat gtcctggtga tatatcataa agggtatgct catggccgat
152341 gaatggatca ccgtgtttat ttggtcctat tgcttccatg ctactagtat agatcaaata
152401 cttgattcct aggtccacac aagctgccaa tatagtctgt gttccataat agtttacttt
152461 catgatttca ttatcggtgt attttccaaa tacatccact agagcagccg tatgaataat
152521 cagatttacc ccatctagcg cttctctcac cttatcaaag tcgtttatat cacattgtat
152581 atagtttata accttaactt tcgaggttat tggttgtgga tcttctacaa tatctatgac
152641 tctgatttct tgaacatcat ctgcactaat taacagtttt actatatacc tgcctagaaa
152701 tccggcacca ccagtaaccg cgtacacggc cattgctgcc actcataata tcagactact
152761 tattctattt tactaaataa tggctgtttg tataatagac cacgataata tcagaggagt
152821 tatttacttt gaaccagtcc atggaaaaga taaagtttta ggatcagtta ttggattaaa
152881 atccggaacg tatagtttga taattcatcg ttacggagat attagtcaag gatgtgattc
152941 cataggcagt ccagaaatat ttatcggtaa catctttgta aacagatatg gtgtagcata

FIG. 23 (CONT.)

```
153001 tgtttattta gatacagatg taaatatatc tacaattatt ggaaaggcgt tatctatttc
153061 aaaaaatgat cagagattag cgtgtggagt tattggtatt tcttacataa atgaaaagat
153121 aatacatttt cttacaatta acgagaatgg cgtttgatat atcagttaat gcgtctaaaa
153181 caataaatgc attagtttac ttttctactc agcaaaataa attagtcata cgtaatgaag
153241 ttaatgatac acactacact gtcgaatttg atagggacaa agtagttgac acgtttattt
153301 catataatag acataatgac accatagaga taagaggggt gcttccagag gaaactaata
153361 ttggttgcgc ggttaatacg ccggttagta tgacttactt gtataataag tatagtttta
153421 aactgatttt agcagaatat ataagacaca gaaatactat atccggcaat atttattcgg
153481 cattgatgac actagatgat ttggctatta aacagtatgg agacattgat ctattattta
153541 atgagaaact taaagtagac tccgattcgg gactatttga ctttgtcaac tttgtaaagg
153601 atatgatatg ttgtgattct agaatagtag tagctctatc tagtctagta tctaaacatt
153661 gggaattgac aaataaaaag tataggtgta tggcattagc cgaacatata tctgatagta
153721 ttccaatatc tgagctatct agactacgat acaatctatg taagtatcta cgcggacaca
153781 ctgagagcat agaggataaa tttgattatt ttgaagacga tgattcgtct acatgttctg
153841 ccgtaaccga cagggaaacg gatgtataat tttttttata gcgtgaagga tatgataaaa
153901 aatataattg ttgtatttat cccattccaa tcaccttata tgattctgta acacaatgaa
153961 ggagtctcat agatgtatag aggtcagata ctggtttgat aaactgttta ttccacatga
154021 gtatgtttga ctttatggtt agacccgcat actttaacaa atcactgaaa attggagtta
154081 ggtattgacc tctcagaatc agttgccgtt ctggaacatt aaatgtattt tttatgatat
154141 actccaacgc atttatgtgg gcatacaaca agtcattact aatggagtat tccaagagtt
```

FIG. 23 (CONT.)

```
154201 ttagttgtct agtatttaac aagagaagag atttcaacag actgtttatg aactcgaatg
154261 ccgcctcatt gtcgcttata ttgatgatgt cgaattctcc caatatcatc accgatgagt
154321 agctcatctt gttatcggga tccaagtttt ctaaagatgt cattaaaccc tcgatcatga
154381 atggatttat catcatcgtt tttatgttgg acatgagctt agtccgtttg tccacatcta
154441 tagacgacga tttctgaatt attttatata tccctctctt taactccagg aacttgtcag
154501 gatggtctac tttaatatgt tctcgtctaa gagatgaaaa tctttggatg gttgcacgcg
154561 acttttctct aaaggatgac gttgcccaag atcctctctt aaatgaatcc atcttatcct
154621 tggacaagat ggacagtcta ttttccttag atggtttaat atttttgtta cccatgatct
154681 ataaaggtag acctaatcgt ctcggatgac ctatatattt attttcagtt ttattatacg
154741 cataaattgt aaaaaatatg ttaggtttac aaaaatgtct cgtggggcat taatcgtttt
154801 tgaaggattg gacaaatctg gaaaaacaac acaatgtatg aacatcatgg aatctatacc
154861 ggcaaacacg ataaaatatc ttaactttcc tcagagatcc actgtcactg gaaagatgat
154921 agatgactat ctaactcgta aaaaaaccta taatgatcat atagttaatc tattattttg
154981 tgcaaataga tgggagtttg catcttttat acaagaacaa ctagaacagg gaattacttt
155041 aatagttgat agatacgcgt tctctggagt agcgtatgcc gccgctaaag gcgcgtcaat
155101 gactctcagt aagagttatg aatctggatt gcctaaaccc gacttagtta tattcttgga
155161 atctggtagc aaagaaatta atagaaacgt cggcgaggaa atttatgaag atgttacatt
155221 ccaacaaaag gtattacaag aatataaaaa aatgattgaa gaaggagata ttcattggca
155281 aattatttct tctgaattcg aggaagatgt aaagaaggag ttgattaaga atatagttat
155341 agaggctata cacacggtta ctggaccagt ggggcaactg tggatgtaat agtgaaatta
155401 cattttttat aaatagatgt tagtacagtg ttataaatgg atgaagcata ttactctggc
```

FIG. 23 (CONT.)

155461 aacttggaat cagtactcgg atacgtgtcc gatatgcata ccgaactcgc atcaatatct
155521 caattagtta ttgccaagat agaaactata gataatgata tattaaacaa ggacattgta
155581 aattttatca tgtgtagatc aaacttggat aatccattta tctctttcct agatactgta
155641 tatactatta tagatcaaga gaactatcag accgaattga ttaattcatt agacgacaat
155701 gaaattatcg attgtatagt taataagttt atgagctttt ataaggataa cctagaaaat
155761 atagtagatg ctatcattac tctaaaatat ataatgaata atccagattt taaaactacg
155821 tatgccgaag tactcggttc cagaatagcc gatatagata ttaaacaagt gatacgtgag
155881 aatatactac aattgtctaa tgatatccgc gaacgatatt tgtgaaaaat attaaaaaaa
155941 aatacttttt ttattaaatg acgtcgcttc gcgaatttag aaaattatgc tgtgatatat
156001 atcacgcatc aggatataaa gaaaaatcta aattaattag agactttata acagataggg
156061 atgataaata tttgatcatt aagctattgc ttcccggatt agacgataga atttataaca
156121 tgaacgataa acaaattata aaattatata gtataatatt taaacaatct caggaagata
156181 tgctacaaga tttaggatac ggatatatag gagacactat taggactttc ttcaaagaga
156241 acacagaaat ccgtccacga gataaaagca ttttaacttt agaagacgtg gatagtttct
156301 taactacgtt atcatccgta actaaagaat cgcatcaaat aaaattattg actgatatcg
156361 catccgtttg tacatgtaat gatttaaaat gtgtagtcat gcttattgat aaagatctaa
156421 aaattaaagc gggtcctcgg tacgtactta acgctattag tcctaatgcc tatgatgtgt
156481 ttagaaaatc taataacttg aaagagataa tagaaaatgc atctaaacaa aatctagact
156541 ctatatctat ttctgttatg actccaatta atcccatgtt agcggaatcg tgtgattctg
156601 tcaataaggc gtttaaaaaa tttccatcag gaatgtttgc ggaagtcaaa tacgatggtg

FIG. 23 (CONT.)

156661 aaagagtaca agttcataaa aataataacg agtttgcctt ctttagtaga aacatgaaac
156721 cagtactctc tcataaagtg gattatctca aagaatacat accgaaagca tttaaaaaag
156781 ctacgtctat cgtattggat tctgaaattg ttcttgtaga cgaacataat gtaccgctcc
156841 cgtttggaag tttaggaata cacaaaaaga aagaatataa aaactctaac atgtgtttgt
156901 tcgtgtttga ctgtttgtac tttgatggat tcgatatgac ggacattcca ttgtacgaac
156961 gaagatcttt tctcaaagat gttatggttg aaatacccaa tagaatagta ttctcagagt
157021 tgacgaatat tagtaacgag tctcagttaa ctgacgtatt ggatgatgca ctaacgagaa
157081 aattagaagg attggtctta aaagatatta atggagtata cgaaccggga aagagaagat
157141 ggttaaaaat aaagcgagac tatttgaacg agggttccat ggcagattct gccgatttag
157201 tagtactagg tgcttactat ggtaaaggag caaagggtgg tatcatggca gtctttctaa
157261 tgggttgtta cgacgatgaa tccggtaaat ggaagacggt taccaagtgt tcaggacacg
157321 atgataatac gttaagggtt ttgcaagacc aattaacgat ggttaaaatt aacaaggatc
157381 ccaaaaaaat tccagagtgg ttggtagtta ataaaatcta tattcccgat tttgtagtag
157441 aggatccgaa acaatctcag atatgggaaa tttcaggagc agagtttaca tcttccaagt
157501 cccataccgc aaatggaata tccattagat ttcctagatt tactaggatt agagaagata
157561 aaacgtggaa agaatctact catctaaacg atttagtaaa cttgactaaa tcttaatagt
157621 tacatacaaa ctgaaaatta aaataacact atttagttgg tggtcgccat ggatggtgtt
157681 attgtatact gtctaaacgc gttagtaaaa catggcgagg aaataaatca tataaaaaat
157741 gatttcatga ttaaaccatg ttgtgaaaga gtttgtgaaa aagtcaagaa cgttcacatt
157801 ggcggacaat ctaaaaacaa tacagtgatt gcagatttgc catatatgga taatgcggta

FIG. 23 (CONT.)

157861 tccgatgtat gcaattcact gtataaaaag aatgtatcaa gaatatccag atttgctaat
157921 ttgataaaga tagatgacga tgacaagact cctactggtg tatataatta ttttaaacct
157981 aaagatgtta ttcctgttat catatctata ggaaaggata aagatgtctg tgaactatta
158041 atctcatcag acatatcgtg tgcatgcgtg gagttaaatt catatcacgt agccattctt
158101 cccatggatg tttccttttt taccaaagga aatgcatcat tgattattct cctgtttgat
158161 ttctctatcg atgcagcacc tctcttaaga agtgtaaccg ataataatgt tattatatct
158221 agacaccagc gtctacatga cgagcttccg agttccaatt ggttcaagtt ttacataagt
158281 ataaagtccg actattgttc tatattatat atggttgttg atggatctgt gatgcatgcg
158341 atagctgata atagaactca cgcaattatt agcaaaaata tattagacaa tactacgatt
158401 aacgatgagt gtagatgctg ttattttgaa ccacagatta ggattcttga tagagatgag
158461 atgctcaatg gatcatcgtg tgatatgaac agacattgta ttatgatgaa tttacctgat
158521 gtaggcaaat ttggatctag tatgttgggg aaatatgaac ctgacatgat taagattgct
158581 ctttcggtgg ctggtaattt aataagaaat cgagactaca ttcccgggag acgaggatat
158641 agctactacg tttacggtat agcctctaga taattttttt aagcacgaaa taaaaaacat
158701 aattttaaac caatctattt catactattt tgtgtgatca ccatggacat aaagatagat
158761 attagtattt ctggtgataa atttacggtg actactagga gggaaaatga agaaagaaaa
158821 aaatatctac ctctccaaaa agaaaaaact actgatgtta tcaaacctga ttatcttgag
158881 tacgatgact tgttagatag agatgagatg tttactattc tagaggaata ttttatgtac
158941 agaggtctat taggcctcag aataaaatat ggacgactct ttaacgaaat taaaaaattc
159001 gacaatgatg cggaagaaca attcggtact atagaagaac tcaagcagaa acttagatta
159061 aattctgaag agggagcaga taactttata gattatataa aggtacaaaa acaggatatc

FIG. 23 (CONT.)

159121 gtcaaactta ctgtatacga ttgcatatct atgataggat tgtgtgcatg cgtggtagat
159181 gtttggagaa atgagaaact gttttctaga tggaaatatt gtttacgagc tattaaactg
159241 tttattaatg atcacatgct tgataagata aaatctatac tgcagaatag actagtatat
159301 gtggaaatgt catagaaagt taaaagttaa tgagagcaaa aatatataag gttgtattcc
159361 atatttgtta tttttctgt aatagttaga aaaatacatt cgatggtcta tctaccagat
159421 tattatgtgt tataaggtac tttttctcat aataaactag agtatgagta agatagtgtt
159481 tttcaaaaca tataaatcta aaattgatgg atgagatata cagctattaa tttcgaaaat
159541 atattttaat ctgataactt taaacatgga ttttgatgg tggtttaacg ttttaaaaaa
159601 agattttgtt attgtagtat atgataatat taaaagatgg atataaagaa tttgctgact
159661 gcatgtacta tttttacat tactacattg gctacggcag atatacctac tccgccacca
159721 acgggtcatg tgacaaggga gaatatcttg ataagaggca taatcaatgt tgtaatcggt
159781 gtccacctgg agaatttgcc aaggttagat gtaatggtaa cgataacaca aaatgtgaac
159841 gctgcccacc tcatacatat accacaatcc caattattct aatggatgtc atcaatgtag
159901 aaaatgccca accggatcat ttgataaggt aaagtgtacc ggaacacaga acagtaaatg
159961 ttcgtgtctt cctggttggt attgtgctac tgattcttca cagactgaag attgttgaaa
160021 ttgtgtacca aaaaggagat gtccatgcgg atactttggt ggaatagatg aacaaggaaa
160081 tcctatttgt aaatcgtgtt gtgttggtga atattgcgac tacctacgta attatagact
160141 tgatccattt cctccatgca aactatctaa atgtaattaa ttatgatttt gatgataatg
160201 ttaccataca ttatatcgct acttggttag tgtattattc agtatgaaga cctattaata
160261 attacttatc ttttgacgat cttgttataa ttataatata aaaatactta tggcatagta

FIG. 23 (CONT.)

```
160321 actcataatt gctgacgcga taaattcgta ataatctgtt ttgttcaaat ttttataagg
160381 aatctacagg cataaaaata aaaatataat ttataatata ctcttacagc gcgccatcat
160441 gaataacagc agtgaattga ttgctgttat taatggattt agaaatagtg gacgattttg
160501 tgatattagt atagttatta atgatgaaag gataaacgct cataaactca tcctatctgg
160561 agcctccgaa tatttttcca ttctgttttc caataatttt atcgattcta atgaatacga
160621 agttaatcta agtcatttag attatcaaag cgttaacgat ttgatcgatt acatttatgg
160681 gatacctttg agcctaacta acgataacgt gaaatatatt ctttcaaccg ctgatttttt
160741 acaaattgga tctgctatta cggagtgtga aaattacata cttaaaaatc tttgttctaa
160801 aaactgtatc gatttctaca tatacgctga taaatataat aacaagaaaa tagaatcagc
160861 gtcgtttaac acaatattac aaaatatttt gagactcatc aacgatgaaa actttaaata
160921 cttaacagag gaatcaatga taaaaatttt aagcgatgat atgttaaata taaaaaatga
160981 ggattttgca ccactaattc tcattaaatg gttagagagt actcaacaat catgcaccgt
161041 cgagttactt agatgcctca gaatatcatt gctttcccca caagttataa aatcacttta
161101 tagtcatcaa ctggttagtt caatctacga atgtataaca ttcttaaaca atatagcatt
161161 cttggatgaa tcatttccta gataccatag catcgagttg atatctatcg gtataagtaa
161221 ttcgcatgat aagatttcca taaactgcta caatcataaa aaaaatacat gggaaatgat
161281 atcttcacgt agatataggt gtagtttcgc agtggccgtc ctggataata ttatctatat
161341 gatgggtgga tatgatcagt ccccgtatag aagttcaaag gttatagcgt acaatacatg
161401 tacaaattct tggatatatg atataccaga gctaaaatat cctcgttcta attgtggggg
161461 actggctgat gacgaataca tttattgtat aggcggcata cgcgatcagg attcatcgtt
```

FIG. 23 (CONT.)

```
161521 gacatctagt attgataaat ggaagccatc aaaaccatat tggcagaagt atgctaaaat
161581 gcgcgaacca aaatgtgata tgggggttgc gatgttaaac ggattaatat atgtcatggg
161641 tggaatcgtt aaaggtgaca cgtgtaccga cgcactagag agtttatcag aagatggatg
161701 gatgaagcat caacgtcttc caataaaaat gtccaatatg tcgacgattg ttcatgatgg
161761 caagatttat atatctggag gttacaacaa tagtagtgta gttaatgtaa tatcgaatct
161821 agtccttagc tataatccga tatatgatga atggaccaaa ttatcatcat taaacattcc
161881 tagaattaat cccgctctat ggtcagcgca taataaatta tatgtaggag gaggaatatc
161941 tgatgatgtt cgaactaata catctgaaac atacgataaa gaaaaagatt gttggacatt
162001 ggataatggt cacgtgttac cacgcaatta tataatgtat aaatgcgaac cgattaaaca
162061 taaatatcca ttggaaaaaa cacagtacac gaatgatttt ctaaagtatt tggaaagttt
162121 tataggtagt tgatagaaca aaatacataa ttttgtaaaa ataaatcact ttttatacta
162181 atatgacacg attaccaata cttttgttac taatatcatt agtatacgct acaccttttc
162241 ctcagacatc taaaaaaata ggtgatgatg caactctatc atgtaatcga aataatacaa
162301 atgactacgt tgttatgagt gcttggtata aggagcccaa ttccattatt cttttagctg
162361 ctaaaagcga cgtcttgtat tttgataatt ataccaagga taaaatatct tacgactctc
162421 catacgatga tctagttaca actatcacaa ttaaatcatt gactgctaga gatgccggta
162481 cttatgtatg tgcattcttt atgacatcaa ctacaaatga cactgataaa gtagattatg
162541 aagaatactc cacagagttg attgtaaata cagatagtga atcgactata gacataatac
162601 tatctggatc tacacattca ccggaaacta gttctaagaa acctgattat atagataatt
162661 ctaattgctc gtcggtattc gaaatcgcga ctccggaacc aattactgat aatgtagaag
162721 atcatacaga caccgtcaca tacactagtg atagcattaa tacagtaagt gcatcatctg
```

FIG. 23 (CONT.)

162781 gagaatccac aacagacgag actccggaac caattactga taaagaagat catacagtta
162841 cagacactgt ctcatacact acagtaagta catcatctgg aattgtcact actaaatcaa
162901 ccaccgatga tgcggatctt tatgatacgt acaatgataa tgatacagta ccaccaacta
162961 ctgtaggcgg tagtacaacc tctattagca attataaaac caaggacttt gtagaaatat
163021 ttggtattac cgcattaatt atattgtcgg ccgtggcaat tttctgtatt acatattata
163081 tatataataa acgttcacgt aaatacaaaa cagagaacaa agtctagatt tttgacttac
163141 ataaatgtct gggatagtaa aatctatcat attgagcgga ccatctggtt taggaaagac
163201 agccatagcc aaaagactat gggaatatat ttggatttgt ggtgtcccat accactagat
163261 ttcctcgtcc tatggaacga gaaggtgttg attaccatta cgttaacaga gaggccatct
163321 ggaagggaat agccgccgga aactttctag aacatactga gtttttagga aatatttacg
163381 gaacttctaa aacagctgtg aatacagcgg ctattaataa tcgtatttgt gtgatggatc
163441 taaacatcga cggtgttaga agtcttaaaa atacgtacct aatgccttac tcggtgtata
163501 taagacctac ctctcttaaa atggttgaga ccaagcttcg ttgtagaaac actgaagcta
163561 acgatgagat tcatcgtcgc gtgatattgg caaaaacgga tatggatgag gccaacgaag
163621 caggtctatt cgacactatt atcattgaag atgatgtgaa tttagcatat agtaagttaa
163681 ttcagatact acaggaccgt attagaatgt attttaacac taattagaga cttaagactt
163741 aaaacttgat aattaataat ataactcgtt tttatatgtg gctatttcaa cgtctaatgt
163801 attagttaaa tattaaaact taccacgtaa aacttaaaat ttaaaatgat atttcattga
163861 cagatagatc acacattatg aactttcaag gacttgtgtt aactgacaat tgcaaaaatc
163921 aatgggtcgt tggaccatta ataggaaaag gtggattcgg tagtatttat actactaatg

FIG. 23 (CONT.)

```
163981 acaataatta tgtagtaaaa atagagccca aagctaacgg atcattattt accgaacagg
164041 cattttatac tagagtactt aaaccatccg ttatcgaaga atggaaaaaa tctcacaata
164101 taaagcacgt aggtcttatc acgtgcaagg catttggtct atacaaatcc attaatgtgg
164161 aatatcgatt cttggtaatt aatagattag gtgcagatct agatgcggtg atcagagcca
164221 ataataatag attaccaaaa aggtcggtga tgttgatcgg aatcgaaatc ttaaatacca
164281 tacaatttat gcacgagcaa ggatattctc acggagatat taaagcgagt aatatagtct
164341 tggatcaaat agataagaat aaattatatc tagtggatta cggattggtt tctaaattca
164401 tgtctaatgg agaacatgtt ccatttataa gaaatccaaa taaaatggat aacggtactc
164461 tagaatttac acctatagat tcgcataaag gatacgttgt atctagacgt ggagatctag
164521 aaacacttgg atattgtatg attagatggt tgggaggtat cttgccatgg actaagatat
164581 ctgaaacaaa gaattgtgca ttagtaagtg ccacaaaaca gaaatatgtt aacaatactg
164641 cgactttgtt aatgaccagt ttgcaatatg cacctagaga attgctgcaa tatattacca
164701 tggtaaactc tttgacatat tttgaggaac ccaattatga cgagtttcgg cacatattaa
164761 tgcagggtgt atattattaa gtgtggtgtt tggtcgatgt aaaatttttg tcgataaaaa
164821 ttaaaaaata acttaattta ttattgatct cgtgtgtaca accgaaatca tggcgatgtt
164881 ttacgcacac gctctcggtg ggtacgacga gaatcttcat gcctttcctg gaatatcatc
164941 gactgttgcc aatgatgtca ggaaatattc tgttgtgtca gtttataata acaagtatga
165001 cattgtaaaa gacaaatata tgtggtgtta cagtcaggtg aacaagagat atattggagc
165061 actgctgcct atgtttgagt gcaatgaata tctacaaatt ggagatccga tccatgatca
165121 agaaggaaat caaatctcta tcatcacata tcgccacaaa aactactatg ctctaagcgg
```

FIG. 23 (CONT.)

```
165181 aatcgggtac gagagtctag acttgtgttt ggaaggagta gggattcatc atcacgtact
165241 tgaaacagga aacgctgtat atggaaaagt tcaacatgat tattctacta tcaaagagaa
165301 ggccaaagaa atgaatgcac ttagtccagg acctatcatt gattaccacg tctggatagg
165361 agattgtatc tgtcaagtta ctgctgtgga cgtacatgga aaggaaatta tgagaatgag
165421 attcaaaaag ggtgcggtgc ttccgatccc aaatctggta aaagttaaac ttggggagaa
165481 tgatacagaa aatctttctt ctactatatc ggcggcacca tcgaggtaac cacctctctg
165541 gaagacagcg tgaataatgt actcatgaaa cgtttggaaa ctatacgcca tatgtggtct
165601 gtcgtatatg atcattttga tattgtgaat ggtaaagaat gctgttatgt gcatacgcat
165661 ttgtctaatc aaaatcttat accgagtact gtaaaaacaa atttgtacat gaagactatg
165721 ggatcatgca ttcaaatgga ttccatggaa gctctagagt atcttagcga actgaaggaa
165781 tcaggtggat ggagtcccag accagaaatg caggaatttg aatatccaga tggagtggaa
165841 gacactgaat caattgagag attggtagag gagttcttca atagatcaga acttcaggct
165901 ggtgaatcag tcaaatttgg taattctatt aatgttaaac atacatctgt ttcagctaag
165961 caactaagaa cacgtatacg gcagcagctt cctttatact ctcatctttt accaacacaa
166021 agggtggata tttgttcatt ggagttgata ataatacaca caaagtaatt ggattcacgg
166081 tgggtcatga ctacctcaga ctggtagaga atgatataga aaagcatatc aaaagacttc
166141 gtgttgtgca tttctgtgag aagaaagagg acatcaagta cacgtgtcga ttcatcaagg
166201 tatataaacc tggggatgag gctacctcga catacgtgtg cgctatcaaa gtggaaagat
166261 gctgttgtgc tgtgtttgca gattggccag aatcatggta tatggatact aatggtatca
166321 agaagtattc tccagatgaa tgggtgtcac atataaaatt ttaattaatg taatagagaa
166381 caaataataa ggttgtaata tcatatagac aataactaac aattaattag taactgttat
```

FIG. 23 (CONT.)

166441 ctctttttta actaaccaac taactatata cctattaata catcgtaatt atagttctta
166501 acatctatta atcattaatt cgcttcttta atttttttata aactaacatt gttaattgaa
166561 aagggataac atgttacaga atataaatta tatatggatt tttttaaaaa ggaaatactt
166621 gactggagta tatatttatc tcttcattat atagcacgcg tgttttccaa tttttccaca
166681 tcccatataa tacaggatta taatctcgtt cgaacatacg agaaagtgga taaaacaata
166741 gttgattttt tatctaggtt gccaaattta ttccatattt tagaatatgg ggaaaatatt
166801 ctacatattt attctatgga tgatgctaat acgaatatta taattttttt tctagataga
166861 gtattaaata ttaataagaa cgggtcattt atacacaatc tcaggttatc atcatccatt
166921 aatataaaag aatatgtata tcaattagtt aataatgatc atccagataa taggataaga
166981 ctaatgcttg aaaatggacg tagaacaaga catttttttgt cctatatatc agatacagtt
167041 aatatctata tatgtatttt aataaatcat ggattttata tagatgccga agacagttac
167101 ggttgtacat tattacatag atgtatatat cactataaga aatcagaatc agaatcatac
167161 aatgaattaa ttaagatatt gttaaataat ggatcagatg tagataaaaa agatacgtac
167221 ggaaacacac cttttatcct attatgtaaa cacgatatca acaacgtgga attgtttgag
167281 atatgtttag agaatgctaa tatagactct gtagacttta atagatatac acctcttcat
167341 tatgtctcat gtcgtaataa atatgatttt gtaaagttat taatttctaa aggagcaaat
167401 gttaatgcgc gtaatagatt cggaactact ccattttatt gtggaattat acacggtatc
167461 tcgcttataa aactatattt ggaatcagac acagagttag aaatagataa tgaacatata
167521 gttcgtcatt taataatttt tgatgctgtt gaatctttag attatctatt atccagagga
167581 gttattgata ttaactatcg tactatatac aacgaaacat ctatttacga cgctgtcagt

FIG. 23 (CONT.)

```
167641 tataatgcgt ataatacgtt ggtctatcta ttaaacagaa atggtgattt tgagacgatt
167701 actactagtg gatgtacatg tatttcggaa gcagtcgcaa acaacaacaa aataataatg
167761 gaagtactat tgtctaaacg accatctttg aaaattatga tacagtctat gatagcaatt
167821 actaaacata aacagcataa tgcagattta ttgaaaatgt gtataaaata tactgcgtgt
167881 atgaccgatt atgatactct tatagatgta cagtcgctac agcaatataa atggtatatt
167941 ttaaaatgtt tcgatgaaat agatatcatg aagagatgtt atataaaaaa taaaactgta
168001 ttccaattag ttttttgtat caaagacatt aatactttaa tgagatacgg taaacatcct
168061 tctttcgtga aatgcactag tctcgacgta tacggaagtc gtgtacgtaa tatcatagca
168121 tctattagat atcgtcagag attaattagt ctattatcca agaagctgga tcctggagat
168181 aaatggtcgt gttttcctaa cgaaataaaa tataaaatat tggaaaactt taacgataac
168241 gaactatcca catatctaaa aatcttataa acactattaa aatataaaat ctaagtagga
168301 taaaatcaca ctacatcatt gtttcctttt agtgctcgac agtgtatact atttttaaca
168361 ctcataaata aaaatgaaaa cgatttccgt tgttacgttg ttatgcgtac tacctgctgt
168421 tgtttattca acatgtactg tacccactat gaataacgct aaattaacgt ctaccgaaac
168481 atcgtttaat gataaacaga aagttacgtt tacatgtgat cagggatatc attcttcgga
168541 tccaaatgct gtctgcgaaa cagataaatg gaaatacgaa aatccatgca aaaaaatgtg
168601 cacagtttct gattacatct ctgaattata taataaaccg ctatacgaag tgaattccac
168661 catgacacta agttgcaacg gcgaaacaaa atattttcgt tgcgaagaaa aaaatggaaa
168721 tacttcttgg aatgatactg ttacgtgtcc taatgcggaa tgtcaacctc ttcaattaga
168781 acacggatcg tgtcaaccag ttaaagaaaa atactcattt ggggaatata tgactatcaa
```

FIG. 23 (CONT.)

168841 ctgtgatgtt ggatatgagg ttattggtgc ttcgtacata agttgtacag ctaattcttg
168901 gaatgttatt ccatcatgtc aacaaaaatg tgatatgccg tctctatcta atggattaat
168961 ttccggatct acattttcta tcggtggcgt tatacatctt agttgtaaaa gtggttttac
169021 actaacgggg tctccatcat ccacatgtat cgacggtaaa tggaatcccg tactcccaat
169081 atgtgtacga actaacgaag aatttgatcc agtggatgat ggtcccgacg atgagacaga
169141 tttgagcaaa ctctcgaaag acgttgtaca atatgaacaa gaaatagaat cgttagaagc
169201 aacttatcat ataatcatag tggcgttaac aattatgggc gtcatatttt taatctccgt
169261 tatagtatta gtttgttcct gtgacaaaaa taatgaccaa tataagttcc ataaattgct
169321 accgtaaata taaatccgtt aaaataatga ataattaata acgaacaagt atcaaaagat
169381 taaagaatta tagctagaat caattgagat gtcttcttca gtggatgttg atatctacga
169441 tgccgttaga gcatttttac tcaggcacta ttataacaag agatttattg tgtatggaag
169501 aagtaacgcc atattacata atatatacag gctatttaca agatgcgccg ttataccgtt
169561 cgatgatata gtacgtacta tgccaaatga atcacgtgtt aaacaatggg tgatggatac
169621 acttaatggt ataatgatga atgaacgcga tgtttctgta agcgttggca ccggaatact
169681 attcatggaa atgtttttcg attacaataa aaatagtatc aacaatcaac taatgtatga
169741 tataattaat agcgtatcta taattctagc taatgagaga tatagaagcg cttttaacga
169801 cgatggtata tacatccgta gaaatatgat taacaagttg tacggatacg catctctaac
169861 tactattggc acgatcgctg gaggtgtttg ttattatctg ttgatgcatc tagttagttt
169921 gtataaataa ttatttcaat atactagtta aaattttaag atttaaaatg tataaaaaac
169981 taataacgtt tttatttgta ataggtgcat tagcatccta ttcgaataat gagtacactc
170041 cgtttaataa actgagtgta aaactctata tagatggagt agataatata gaaaattcat

FIG. 23 (CONT.)

170101 atactgatga taataatgaa ttggtgttaa attttaaaga gtacacaatt tctattatta
170161 cagagtcatg cgacgtcgga tttgattcca tagatataga tgttataaac gactataaaa
170221 ttattgatat gtataccatt gactcgtcta ctattcaacg cagaggtcac acgtgtagaa
170281 tatctaccaa attatcatgc cattatgata agtaccctta tattcacaaa tatgatggtg
170341 atgagcgaca atattctatt actgcagagg gaaaatgcta taaaggaata aaatatgaaa
170401 taagtatgat caacgatgat actctattga gaaaacatac tcttaaaatt ggatctactt
170461 atatatttga tcgtcatgga catagtaata catattattc aaaatatgat ttttaaaaat
170521 ttaaaatata ttatcacttc agtgacagta gtcaaataac aaacaacacc atgagatata
170581 ttataattct cgcagttttg ttcattaata gtatacacgc taaaataact agttataagt
170641 ttgaatccgt caattttgat tccaaaattg aatggactgg ggatggtcta tacaatatat
170701 cccttaaaaa ttatggcatc aagacgtggc aaacaatgta tacaaatgta ccagaaggaa
170761 catacgacat atccgcattt ccaaagaatg atttcgtatc tttctgggtt aaatttgaac
170821 aaggcgatta taaagtggaa gagtattgta cgggactatg cgtcgaagta aaaattggac
170881 caccgactgt aacattgact gaatacgacg accatatcaa tttgtacatc gagcatccgt
170941 atgctactag aggtagcaaa aagattccta tttacaaacg cggtgacatg tgtgatatct
171001 acttgttgta tacggctaac ttcacattcg gagattctaa agaaccagta ccatatgata
171061 tcgatgacta cgattgcacg tctacaggtt gcagcataga ctttgtcaca acagaaaaag
171121 tgtgcgtgac agcacaggga gccacagaag ggtttctcga aaaaattact ccatggagtt
171181 cgaaagtatg tctgacacct aaaaagagtg tatatacatg cgcaattaga tccaaagaag
171241 atgttcccaa tttcaaggac aaaatggcca gagttatcaa gagaaaattt aataaacagt

FIG. 23 (CONT.)

171301 ctcaatctta tttaactaaa tttctcggta gcacatcaaa tgatgttacc acttttctta
171361 gcatgcttaa cttgactaaa tattcataac taatttttat taatgataca aaaacgaaat
171421 aaaactgcat attatacact ggttaacgcc cttataggct ctaaccattt tcaagatgag
171481 gtccctgatt atagtccttc tgttcccctc tatcatctac tccatgtcta ttagacaatg
171541 tgagaagact gaagaggaaa catggggatt gaaaataggg ttgtgtataa ttgccaaaga
171601 tttctatccc gaaagaactg attgcagtgt tcatctccca actgcaagtg aaggattgat
171661 aactgaaggc aatggattca gggatatacg aaacaccgat aaattataaa aaaagcaatg
171721 tgtccgctgt ttccgttaat aatactattt tcgtaactgg cggattattc ataaataact
171781 ctaatagcac gatcgtggtt aacaatatgg aaaaacttga catttataaa gacaaacaat
171841 ggtcgattat agaaatgcct atggctaggg tatatcacgg catcgactcg acatttggaa
171901 tgttatattt tgccggaggt ctatccgtta ccgaacaata tggtaattta gagaaaaaca
171961 acgagatatc ttgttacaat cctagaacga ataagtggtt tgatatttca tatactattt
172021 ataagatatc catatcatca ttgtgtaaac taaataacgt cttctatgta tttagtaagg
172081 acattggata tgtggaaaag tatgatggtg catggaagtt agtacatgat cgtctccccg
172141 ctataaaggc attatcaact tctccttatt gattgaaaat gaaaatataa atagttttta
172201 tgtatagcag tattacccta tagttttatt gcttactact aacatggata cagatgttac
172261 aaatgtagaa gatatcataa atgaaataga tagagagaaa gaagaaatac taaaaaatgt
172321 agaaattgaa aataataaaa acattaacaa gaatcatcca agtggatata ttagagaagc
172381 actcgttatt aataccagta gtaatagtga ttccattgat aaagaagtta tagaatgtat
172441 ctgtcacgat gtaggaatat agatcatatc tactaatttt tataatcgat acaaaacata

FIG. 23 (CONT.)

172501 aaaaacaact cgttattaca tagcaggcat ggaatccttc aagtattgtt ttgataacga
172561 tggcaagaaa tggattatcg gaaatacttt atattctggt aattcaatac tatataaggt
172621 cagaaaaaat ttcactagtt cgttctacaa ttacgtaatg aagatagatc acaaatcaca
172681 caagccattg ttgtctgaaa tacgattcta tatatctgta ttggatcctt tgactatcga
172741 caactggaca cgggaacgtg gtataaagta tttggctatt ccagatctgt atggaattgg
172801 agaaaccgat gattatatgt tcttcgttat aaagaatttg ggaagagtat tcgccccaaa
172861 ggatactgaa tcagtcttcg aagcatgcgt cactatgata aacacgttag agtttataca
172921 ctctcaagga tttacccatg gaaaaataga accgaggaat atactgatta gaaataaacg
172981 tctttcacta attgactatt ctagaactaa caaactatac aagagtggaa actcacatat
173041 agattacaac gaggacatga taacttcagg aaatatcaat tatatgtgtg tagacaatca
173101 tcttggagca acagtttcaa gacgaggaga tttagaaatg ttgggatatt gcatgataga
173161 atggttcggt ggcaaacttc catggaaaaa cgaaagtagt ataaaagtaa taaaacaaaa
173221 aaaagaatat aaaaaattta tagctacttt ctttgaggac tgttttcctg aaggaaatga
173281 acctctggaa ttagttagat atatagaatt agtatacacg ttagattatt ctcaaactcc
173341 taattatgac agactacgta aactgtttat acaagattga aattatattc ttttttttat
173401 agagtgtggt agtgttacgg atatttaata ttagactatc tctatcgcgc tacacgacca
173461 atatcgatta ctatggatat cttcagggaa atcgcatctt ctatgaaagg agagaatgta
173521 ttcatttctc cagcgtcaat ctcgtcagta ttgacaatac tgtattatgg agctaatgga
173581 tccactgctg aacagctatc aaaatatgta gaaaaggagg agaacatgga taaggttagc
173641 gctcaaaata tctcattcaa atccataaat aaagtatatg ggcgatattc tgccgtgttt
173701 aaagattcct ttttgagaaa aattggcgat aagtttcaaa ctgttgactt cactgattgt

FIG. 23 (CONT.)

```
173761 cgcactatag atgcaatcaa caagtgtgta gatatcttta ctgaggggaa aatcaatcca
173821 ctattggatg aaccattgtc tcctgatacc tgtctcctag caattagtgc cgtatacttt
173881 aaagcaaaat ggttgacgcc attcgaaaag gaatttacca gtgattatcc cttttacgta
173941 tctccgacgg aaatggtaga tgtaagtatg atgtctatgt acggcaaggc atttaatcac
174001 gcatctgtaa aggaatcatt cggcaacttt tcaatcatag aactgccata tgttggagat
174061 actagtatga tggtcattct tccagacaag attgatggat tagaatccat agaacaaaat
174121 ctaacagata caaattttaa gaaatggtgt aactctctgg aagctacgtt tatcgatgtt
174181 cacattccca agtttaaggt aacaggctcg tataatctgg tggatactct agtaaagtca
174241 ggactgacag aggtgttcgg ttcaactgga gattatagca atatgtgtaa ttcagatgtg
174301 agtgtcgacg ctatgatcca caaaacgtat atagatgtca atgaagagta tacagaagca
174361 gctgcagcaa cttgtgcact ggtgtcagac tgtgcatcaa caattacaaa tgagttctgt
174421 gtagatcatc cgttcatcta tgtgattagg catgttgatg gaaaaattct tttcgttggt
174481 agatattgct ctccgacaac taattgttaa ccattttttt taaaaaatag aaaaaacatg
174541 tggtattagt gcaggtcgtt attcttccaa ttgcaattgg taagatgacg gccaacttta
174601 gtacccacgt cttttcacca cagcactgtg gatgtgacag actgaccagt attgatgacg
174661 tcagacaatg tttgactgaa tatatttatt ggtcgtccta tgcataccgc aacaggcaat
174721 gcgctggaca attgtattcc acactcctct cttttagaga tgatgcggaa ttagtgttca
174781 tcgacattcg cgagctggta aaaaatatgc cgtgggatga tgtcaaagat tgtgcagaaa
174841 tcatccgttg ttatataccg gatgagcaaa aaaccatcag agagatttcg gccatcatcg
174901 gactttgtgc atatgctgct acttactggg gaggtgaaga ccatcccact agtaacagtc
```

FIG. 23 (CONT.)

```
174961 tgaacgcatt gtttgtgatg cttgagatgc tcaattacgt ggattataac atcatattcc
175021 ggcgtatgaa ttgatgagtt gtacatcttg acattttctt ctttcttctc ttctcccttt
175081 cccagaaaca aacttttttt acccactata aaataaaatg agtatactac ctgttatatt
175141 tctttctata tttttttatt cttcattcgt tcagactttt aacgcgcctg aatgtatcga
175201 caaagggcaa tattttgcat cattcatgga gttagaaaac gagccagtaa tcttaccatg
175261 tcctcaaata aatacgctat catccggata taatatatta gatattttat gggaaaaacg
175321 aggagcggat aatgatagaa ttataccgat agataatggt agcaatatgc taattctgaa
175381 cccgacacaa tcagactctg gtatttatat atgcattacc acgaacgaaa cctactgtga
175441 catgatgtcg ttaaatttga caatcgtgtc tgtctcagaa tcaaatatag atcttatctc
175501 gtatccacaa atagtaaatg agagatctac tggcgaaatg gtatgtccca atattaatgc
175561 atttattgct agtaacgtaa acgcagatat tatatggagc gggcatcgac gccttagaaa
175621 taagagactt aaacaacgga cacctggaat tattaccata gaagatgtta gaaaaaatga
175681 tgctggttat tatacatgtg ttttagaata tatatacggt ggcaaaacat ataacgtaac
175741 cagaattgta aaattagagg tacgggataa aataataccct tctactatgc aattaccaga
175801 tggcattgta acttcaatag gtagtaattt gactattgca tgcagagtat cgttgagacc
175861 tcccacaacg gatgcagacg tcttttggat aagtaatggt atgtattacg aagaagatga
175921 tggggacgga aacggtagaa taagtgtagc aaataaaatc tatatgaccg ataagagacg
175981 tgttattaca tcccggttaa acattaatcc tgtcaaggaa gaagatgcta caacgtttac
176041 gtgtatggcg tttactattc ctagcatcag taaaacagtt actgttagta taacgtgaat
176101 gtatgttgtt acatttccat gtcaattgag tttataagaa tttttataca ttatcttcca
```

FIG. 23 (CONT.)

```
176161 acaagcaatt gacgaacgta ttgctatgat taactcccac gatactatgc atattattaa
176221 tcattaactt gcagactata cctagagcta ttttgacata ctcgtgttct tgtgtaattg
176281 cagtatctat attattaaag tacgtaaatc tagctatagt tttattattt aattttagat
176341 aatataccgt ctccttattt ttaaaaattg ccacatcctt tattaaatca tgaatgggaa
176401 tttctatgtc atagttaata tattgtgaac aacaagagca gatatctata ggaaagggtg
176461 gaatgcgata cattgatcta tgtagtttta aaacacacgc aaactttgaa gaatttatat
176521 aaatcattcc atcgatacat ccttctatgt tgagatgtat atatccagga attcgtttat
176581 taatatcggg aaatgtataa actaaaacat tgcccggaag cggagcttct accggagtta
176641 tatcagtttt taacttacaa aatgtaacca atacctttgc atgacttgtt ttgttcggca
176701 acgttagttt aaacttgacg aatggattaa ttacaatagc atgatccgcg catctattaa
176761 gtttttttac tttaacgccc ttgtatgttt ttacagagac tttatctaaa tttctagtgc
176821 ttgtatgtgt tataaatata acgggatata gaactgaatc acctacctta gatacccaat
176881 tacattttat cagatccaga taataaacaa attttgtcgc cctaactaat tctatattgt
176941 tatatatttt acaattggtt atgatatcat gtaataactt ggaatctaac gcacatcgtc
177001 gtacgtttat acaattgtga tttagtgtag tatatctaca catgtatttt tccgcgctat
177061 agtattctgg actagtgata aaactatcgt tatatctgtc ttcaatgaac tcatcgagat
177121 attgctctct gtcatattca tacacctgca taaactttct agacatctta caatccgtgt
177181 tattttagga tcatatttac atatttacgg gtatatcaaa gatgttagat tagttaatgg
177241 gaatcgtcta taataatgaa tattaaacaa ttatatgagg acttttacca caaagcatca
177301 taaaaatgag tcgtcgtctg atttatgttt taaatatcaa ccgcgaatca actcataaaa
177361 tacaagagaa tgaaatatat acatatttta gtcattgcaa tatagaccat acttctacag
```

FIG. 23 (CONT.)

177421 aacttgattt tgtagttaaa aactatgatc taaacagacg acaacctgta actgggtata
177481 ctgcactaca ctgctatttg tataataatt actttacaaa cgatgtactg aagatattat
177541 taaatcatgg agtggatgta acgatgaaaa ccagtagcgg acgtatgcct gtttatatat
177601 tgcttactag atgttgcaat atttcacatg atgtagtgat agatatgata gacaaagata
177661 aaaaccactt attacataga gactattcca acctattact agagtatata aaatctcgtt
177721 acatgttatt aaaggaagag gatatcgatg agaacatagt atccacttta ttagataagg
177781 gaatcgatcc taactttaaa caagacggat atacagcgtt acattattat tatttgtgtc
177841 tcgcacacgt ttataaacca ggtgagtgta gaaaaccgat aacgataaaa aaggccaagc
177901 gaattatttc tttgtttata caacatggag ctaatctaaa cgcgttagat aattgtggta
177961 atacaccatt ccatttgtat cttagtattg aaatgtgtaa taatattcat atgactaaaa
178021 tgctgttgac ttttaatccg aatttcgaaa tatgtaataa tcatggatta acgcctatac
178081 tatgttatat aacttccgac tacatacaac acgatattct tgttatgtta atacatcact
178141 atgaaacaaa tgttggagaa atgccgatag atgagcgtcg tataatcgta ttcgagttta
178201 tcaaaacata ttctacacgt cctgcagatt cgataactta tttgatgaat aggtttaaaa
178261 atatagatat ttatacccgc tatgaaggaa agacattatt acacgtagca tgtgaatata
178321 ataatacaca cgtaatagat tatcttatac gtatcaacgg agatataaat gcgttaaccg
178381 acaataacaa acacgctaca caactcatta tagataacaa agaaaattcc ccatatacca
178441 ttaattgttt actgtatata cttagatata ttgtagataa gaatgtgata agatcgttgg
178501 tggatcaact tccatctcta cctatcttcg atataaaatc atttgagaaa ttcatatcct
178561 actgtatact tttagatgac acattttaca atagacacgt taggaatcgc gattctaaaa

FIG. 23 (CONT.)

178621 cgtatcgata cgcattttca aaatacatgt cgtttgataa atacgatggt ataataacta
178681 aatgtcataa agaaacaata ttgctcaaac tatccactgt tctagacact acactatatg
178741 cagttttaag atgccataat tcgaaaaagt taagaagata cctcaccgag ttaaaaaaat
178801 ataataacga taagtccttt aaaatatatt ctaatattat gaatgagaga taccttaatg
178861 tatattataa agatatgtac gtgtcaaagg tatatgataa actatttcct gttttcacag
178921 ataaaaattg tctactaaca ttactacctt cagaaattat atacgaaata ttatacatgc
178981 tgacaattaa cgatctttat aatatatcgt atccacctac caaagtatag ttgtattttt
179041 ctcatgcgat gtgtgtaaaa aaactgatat tatataaata ttttagtgcc gtataataaa
179101 gatgacgatg aaaatgatgg tacatatata tttcgtatca ttattgttat tgctattcca
179161 cagttacgcc atagacatcg aaaatgaaat cacagaattc ttcaataaaa tgagagatac
179221 tctaccagct aaagactcta aatggttgaa tccagcatgt atgttcggag gcacaatgaa
179281 tgatatagcc gctctaggag agccattcag cgcaaagtgt cctcctattg aagacagtct
179341 tttatcgcac agatataaag actatgtggt taaatgggaa aggctagaaa aaaatagacg
179401 gcgacaggtt tctaataaac gtgttaaaca tggtgattta tggatagcca actatacatc
179461 taaattcagt aaccgtaggt atttgtgcac cgtaactaca aagaatggtg actgtgttca
179521 gggtatagtt agatctcata ttagaaaacc tccttcatgc attccaaaaa catatgaact
179581 aggtactcat gataagtatg gcatagactt atactgtgga attctttacg caaaacatta
179641 taataatata acttggtata aagataataa ggaaattaat atcgacgaca ttaagtattc
179701 acaaacggga aaggaattaa ttattcataa tccagagtta gaagatagcg gaagatacga
179761 ctgttacgtt cattacgacg acgttagaat caagaatgat atcgtagtat caagatgtaa

FIG. 23 (CONT.)

179821 aatacttacg gttataccgt cacaagacca caggtttaaa ctaatactag atccaaaaat
179881 caacgtaacg ataggagaac ctgccaatat aacatgcact gctgtgtcaa cgtcattatt
179941 gattgacgat gtactgattg aatgggaaaa tccatccgga tggcttatag gattcgattt
180001 tgatgtatac tctgttttaa ctagtagagg cggtattacc gaggcgacct tgtactttga
180061 aaatgttact gaagaatata taggtaatac atataaatgt cgtggacaca actattattt
180121 tgaaaaaacc cttacaacta cagtagtatt ggagtaaata tacaatgcat ttttatatac
180181 attactgaat aattattatt attatttata tcgtatttgt gctataacgc gactatctag
180241 gtatttgtat ctcaccgata gagaacatat aaatgtagac tctattaaac agttgtgtaa
180301 aatatcagat cctaatgcat gttatagatg tggatgtacg gctttacatg agtactttta
180361 taattataga tcagtcaacg gaaaatacaa gtatagatac aacggttact atcaatatta
180421 tttatctagc gattatgaaa attataatga atattattat gatgattatg atagaactgg
180481 tatgaacagt gagagtgata atatatcaat caaaacagaa tatgaattct atgatgaaac
180541 acaagatcaa agtacacaac tagtaggtta cgacattaaa ctcaaaacca atgaggatga
180601 ttttatggct atgatagatc agtgggtgtc catgattata tagatgaatc aattaataaa
180661 gtagtatatg gaagagagtc tcacgtaaga tggcgggata tatggcaaga acataatgat
180721 ggcgtataca gtataggaaa ggagtgcata gataatatat acgaagacaa ccataccgta
180781 gacgaattct acaagataga cagcgtatca gatgtagatg acgcggaaca catatctccg
180841 ataactaatg atgtatctac acaaacatgg gaaaagaaat cagagttaga tagatacatg
180901 gaaatgtatc ctcgtcatag atatagtaag cattctgtct ttaagggatt ttctgacaaa
180961 gttagaaaaa atgatttaga catgaatgtg gtaaaagaat tactttctaa cggtgcatct
181021 ctaacaatta aggatagcag taataaggat ccaataaccg tttattttcg aagaacgata

FIG. 23 (CONT.)

181081 atgaatttag aaatgattga tgaacgaaag tatatagtac actcctatct aaaaaattat
181141 aaaaatttcg attatccatt tttcaggaag ttagttttga ctaataaaca ttgtctcaac
181201 aattattata atataagcga cagcaaatat ggaacaccgc tacatatatt ggcgtctaat
181261 aaaaaattaa taactcctaa ttacatgaag ttattagtgt ataacggaaa tgatataaac
181321 gcacgaggtg aagatacaca aatgcgaact ccattacaca aatatttgtg taaatttgta
181381 tatcataata ttgaatatgg tatccgatac tataatgaaa agattataga cgcatttata
181441 gagttaggag ccgatctaac tattccaaat gacgatggaa tgataccagt agtttactgt
181501 atacactcaa atgccgaata tggttataac aatattacta acataaagat aatacgtaaa
181561 ctacttaatc ttagtagacg tgcgtcacat aatctattta gagatcgagt catgcacgat
181621 tatataagta atacatatat tgatcttgag tgtttagata ttattagatc gttggatgga
181681 ttcgatatca atggttactt tgaaggacgt acaccacttc attgcgctat acaacataac
181741 ttcactcaga ttgctaagta cttattagat cgaggagctg atatagtcgt acccaacaca
181801 ttgattatac atcagtacat acagtaaata gcatagatat ggaggaggat acaaatattt
181861 caaataaagt tataaggtac aacactgtca ataatatatg ggaaacatta cctaacttct
181921 ggactggaac tataaatcca ggcgtggtct cgcataaaga tgatatatat gttgtatgcg
181981 acatcaaaga tgaaaaaaat gttaaaactt gtatatttag atataacacg aatacgtata
182041 acggatggga attggtcacg acgacagaaa gcagattatc agctctgcat actattcttt
182101 ataacaatac cataatgatg ttacattgtt atgaatcgta tatgttacaa gatacattta
182161 atgtgtacac tcgcgaatgg aatcatatgt gtcatcaaca ttcgaatagt tatatcatgt
182221 acaatatact acccatctac taaatataat agaataaaat aaatgagtat gatcatttta

FIG. 23 (CONT.)

182281 gataacgatt gattttatca ttaccgcttc attcttatat tctttgctta cggaacctat
182341 atttagaaac atctactaac gattttttat gcttgcatta ttaatggtat gtaatatgat
182401 tgattgtgta cgcaatacca atttgttaag tatgaatacg gggtacaaac ataaactgaa
182461 gtttaacatt atttatttat gatatatatc gttattgttt ggtctatacc atggatatct
182521 ttaaagaact aatcttaaaa cacacggatg aaaatgtttt gatttctcca gtttctattt
182581 tatctacttt atctattcta aatcatggag cagctggttc tacagctgaa caactatcaa
182641 aatatataga gaatatgaat gagaatacac ccgatgacaa taatgacatg gacgtagata
182701 ttccgtattg tgcgacacta gctaccgcaa ataaaatata cggtagcgat agtatcgagt
182761 tccacgcctc cttcctacaa aaaataaaag acgattttca aactgtaaac tttaataatg
182821 ctaaccaaac aaaggaacta atcaacgaat gggttaagac aatgacaaat ggtaaaatta
182881 attccttatt gactagtccg ctatccatta atactcgtat gacagttgtt agcgccgtcc
182941 attttaaagc aatgtggaaa tatccatttt ctaaacatct tacatataca gacaagtttt
183001 atatttctaa gaatatagtt accagtgttg atatgatggt gagcactgag aataacttgc
183061 aatatgtaca tattaatgaa ttattcggag gattctctat tatcgatatt ccatacgagg
183121 gaaactctag tatggtaatt atactaccgg acgacataga aggtatatat aacatagaaa
183181 aaaatataac agatgaaaaa tttaaaaaat ggtgtggtat gttatctact aaaagtatag
183241 acttgtatat gccaaagttt aaagtggaaa tgacagaacc gtataatctg gtaccgattt
183301 tagaaaattt aggacttact aatatattcg gatattatgc agattttagc aagatgtgta
183361 atgaaactat cactgtagaa aaatttctac atacgacgtt tatagatgtt aatgaggagt
183421 atacagaagc atcggccgtt acaggagtat ttatgactaa cttttcgatg gtatatcgta

FIG. 23 (CONT.)

183481 cgaaggtcta cataaaccat ccattcatgt acatgattaa agacaacaca ggacgtatac
183541 tttttatagg gaaatactgc tatccgcaat aaatataaac aaatagactt ttatcacgtt
183601 tatctatgtc taaatattac aaatagtaat agtataaact aaagctgata atacttaaaa
183661 aaataataat atcatttaca attaatagta taaactaaaa attaaacaaa tcgttattat
183721 aagtaatatc aaaatgatga tatacggatt aatagcgtgt cttatattcg tgacttcatc
183781 catcgctagt ccactttata ttcccgttat tccacccatt tcggaagata aatcgttcaa
183841 tagtgtagag gtattagttt ccttgtttag agatgaccaa aaagactata cggtaacttc
183901 tcagttcaat aactacacta tcgataccaa agactggact atcggcgtac tatccacacc
183961 tgatggtttg gatataccat tgactaatat aacttattgg tcacggttta ctataggtcg
184021 tgcattgttc aaatcagagt ctgaggatat tttccaaaag aaaatgagta ttctaggtgt
184081 ttctatagaa tgtaagaagt cgtcgacatt acttactttt ttgaccgtgc gtaaaatgac
184141 tcgagtattt aataaatttc cagatatggc ttattatcga ggagactgtt taaaagccgt
184201 ttatgtaaca atgacttata aaaatactaa aactggagag actgattaca cgtacctctc
184261 taatgggggg ttgcctgcat actatcgtaa tggggtcgat ggttgattat tgattagtat
184321 attccttatt ctttttattc acacaaaaag aacattttta taaacatgaa accactgtct
184381 aaatgtaatt atgatcttga tttatagatg aagatcagcc tttagaggat tttaaccagt
184441 atgtttaata tgaaaaaaat aaacataaca tattttgaga ttaagcgcta ttgtgcaaga
184501 ttatattaga atcaaattaa tctttcatac gagaaaaata acgacatacg tcgtcaacaa
184561 attaaacttt ttatttatta gttaactagc ttatagaact tgctcattgt tatgtttcta
184621 aaacgggtac gacatatagg acaattatcc gacgcaccgg tttctcttcg tgttttatgc
184681 catatattga tgcatgttat gcaaaatata tgagtacacg aatccaataa accaaagtat

FIG. 23 (CONT.)

184741 ctatcgtttt gagtaaacaa cttcatagca aattccacat tctttttctt tacttactct
184801 atacacgtcc tcgtatttat ccagtatttt gatgatatcc aactcagaaa tggttgttgt
184861 attattgggt gtattgggag tataggtatt attagctatg taccaattta ccaaccctct
184921 taatattgat tgaacaatca catcggttat ccaatcaata accacattaa taactaaatt
184981 gtagtgtata tatagaccat atatgtttct atttttttga cagttacgta tagtttcagt
185041 aagttttgat tgttgtattc ctgtatctct agataagtta gtcatatagt cccttccggc
185101 gatacgtttt ttccaagccc gaaattgatt agccaaatgt gtatttattt ttgtgatatt
185161 gatataatat gtaatgttat taatatttcg gataatgcat actgttagtc ttatatcatt
185221 tggttcatct atgtattgta atattgttac atgatctata gatgatgtat tgattttggc
185281 aggatcgaat tccatatccg cgactaaaca gtgaaaaaaa tgtaaatact ttttaaattt
185341 taaattagta aaactttttt ttatttttta tgattccaaa aatactgaat acaaagtcct
185401 aaattataaa tatggagatc atactaccac aacttattat tatgcatact cagccggtgt
185461 aatagataga tatatataat tctattacac cggcagacaa ttaccgatcg gtatttgtcg
185521 ttaccaacat accgtataat atgtaatata caattccata acccattgac agttgttata
185581 catcaaaatt gcaattcttt tgattacgat gttataagaa tgtagttaat tgatgtatga
185641 tgttaatgtg tcctctttcc tcttataaca tcgtaatcaa aaactttttt ataatatata
185701 cctaataatg tgtcttaata gttctcgtga ttcgtcaaac aatcattctt ataaaatata
185761 ataaagcaac gtaaaacaca taaaaataag cgtaactaat aagacaatgg atatttacga
185821 cgataaaggt ctacagacta ttaaactgtt taataatgaa tttgattgta taaggaatga
185881 catcagagaa ttatttaaac atgtaactga ttccgatagt atacaacttc cgatggaaga

FIG. 23 (CONT.)

185941 caattctgat attatagaaa atatcagaaa aatactatat agacgattaa aaaatgtaga
186001 atgtgttgac atcgatagta caataacttt tatgaaatac gatccaaatg atgataataa
186061 gcgtacgtgt tctaattggg tacccttaac taataactat atggaatatt gtctagtaat
186121 atatttggaa acaccgatat gtggaggcaa aataaaatta taccacccta caggaaatat
186181 aaagtcggat aaggatatta tgtttgcaaa gactctagac tttaaatcaa agaaagtgtt
186241 aactggacgt aaaacaattg ccgttctaga catatccgtt tcatataata gatcaatgac
186301 tactattcac tacaacgacg acgttgatat agatatacat actgataaaa atggaaaaga
186361 gttatgttat tgttatataa caatagatga tcattacttg gttgatgtgg aaactatagg
186421 agttatagtc aatagatctg gaaaatgtct gttagtaaat aaccatctag gtataggtat
186481 cgttaaagat aaacgtataa gcgatagttt tggagatgta tgtatggata caatatttga
186541 cttttctgaa gcacgagagt tattttcatt aactaatgat gataacagga atatagcatg
186601 ggacactgat aaactagacg atgatacaga tatatggact cccgtcacag aagatgatta
186661 caaatttctt tctagactag tattgtatgc aaaatctcaa tcggatactg tattcgacta
186721 ttatgttctt actggtgata cggaaccacc cactgtattc attttcaagg taactagatt
186781 ttactttaat atgccgaaat aaaaaatttt tgtataatat ctagaggtag aggtattgtt
186841 tagataaata caaataacat agatacatcg catacttagc atttttataa atatacataa
186901 gacatacact ttatacattt tttttgtaaa aatactcata aaaaaattta taaaaattat
186961 ggcacaacca tatcttgtat aggtagttta gttcgtcgag tgaacctata aacagataat
187021 agacaacacg taataataat aatgcctact aatacaagca taataccggg agatgggata
187081 tatgacgttg tagtgtttgg gttttctgaa cgttgatagt ctactaatac tacatgctga

FIG. 23 (CONT.)

187141 catctaatgc ctgtataacc atgagagcat ctacaataca taccgtcaat atctctagcg
187201 tggatacagt caccgtgtaa acaatatcca tctccctctg gaccgcataa tctgatagct
187261 ggaatatctg ttgtagcgtt tgtaatttct ggcgatgtcg tttcgatagc gttaccacta
187321 tcggcgaatg atctgattat catagcagcg aacaacaaca tcagatattt catcgacatt
187381 tttgatggat tttgtgttta tgctgtttct cagtgtgtgt ttatgacaag attgggaatt
187441 ttatattatt aattcagtaa tataaactaa taatatattg ttaattgtgt aaataatata
187501 aaaataacaa tacaatattg aatgtgttgc tgttaaaaat gatcataaac acggagttta
187561 ttttatatgt ctcgcataaa cattactaaa aaaatatatt gttctgtttt tctttcacat
187621 ctttaattat gaaaaagtaa atcattatga gatggacgag attgtacgca tcgttcgcga
187681 cagtatgtgg tacataccta acgtatttat ggacgacggt aagaatgaag gtcacgtttc
187741 tgtcaacaat gtctgtcata tgtatttcac gttctttgat gtggatacat cgtctcatct
187801 gtttaagcta gttattaaac actgcgatct gaataaacga ggtaactctc cattacattg
187861 ctatacgatg aatacacgat ttaatccatc tgtattaaag atattgttac accacggcat
187921 gcgtaacttt gatagcaagg atgaaaaagg acaccactat caatcgataa caagatcttt
187981 gatatactaa cggacaccat tgatgacttt agtaaatcat ccgatctatt gctgtgttat
188041 cttagatata aattcaatgg gagcttaaac tattacgttc tgtacaaagg atccgacgag
188101 gatgaactca cttctcttca ttactactgt aaacacatat ccacgttcta caaaagcaat
188161 tattacaagt taagtcacac taagatgcga gccgagaagc gattcatcta cgcgataata
188221 gattatggag caaacattaa cgcggttaca cacttacctt caacagtata ccaaacatag
188281 tcctcgtgtg gtgtatgctc ttttatctcg aggagccgat acgaggatac gtaataatct
188341 tgattgtaca cccatcatgg aacgattgtg caacaggtca tattctcata atgttactca

FIG. 23 (CONT.)

188401 attggcacga acaaaaggaa gaaggacaac atctacttta tctattcata aaacataatc
188461 aaggatacac tctcaatata ctacggtatc tactagatag gttcgacatt cagaaagacg
188521 aatactataa taccgccttt caaaattgta acaacaatgt tgcctcatac atcggatacg
188581 acatcaacct tccgactaaa gacggtattc gacttggtgt ttgaaaacag aaacatcata
188641 tacaaggcgg atgttgtgaa tgacatcatc caccacagac tgaaagtatc tctacctatg
188701 attaaatcgt tgttctacaa gatgtctctc cctacgacga ttactacgta aagaagataa
188761 tagcctactg cctattaagg gacgagtcat tcgcggaact acatagtaaa ttctgtttaa
188821 acgaggacta taaaagtgta tttatgaaaa atatatcatt cgataagata gattccatca
188881 tcgtgacata agtcgcctta aagagattcg aatctccgac accgacctgt atacggtatc
188941 acagctatct taaagccata cattcagaca gtcacatttc atttcccatg tacgacgatc
189001 tcatagaaca gtgccatcta tcgatggagc gtaaaagtaa actcgtcgac aaagcactca
189061 ataaattaga gtctaccatc ggtcaatcta gactatcgta tttgcctccg gaaattatgc
189121 gcaatatcat ctaaacagta tgttgtacga aaagaaccat tacaaatatt atccatgata
189181 gaaagaaaat atctatatga ttggagaagt aggaaacagg aacaagacga cgattactac
189241 attattaaat catgaagtcc gtattatact cgtatatatt gtttctctca tgtataataa
189301 taaacggaag agatatagca ccgcatgcac catccgatgg aaagtgtaaa gacaacgaat
189361 acaaacgcca taatttgtgt ccgggaacat acgcttccag attatgcgat agcaagacta
189421 acacacaatg tacgccgtgt ggttcgggta ccttcacatc tcgcaataat catttacccg
189481 cttgtctaag ttgtaacgga agacgcgacc gtgtaacacg actcacaata gaatctgtga
189541 atgctctccc ggatattatt gtcttctcaa aggatcatcc ggatgcaagg catgtgtttc

FIG. 23 (CONT.)

189601 ccaaacaaaa tgtggaatag gatacggagt atccggagac gtcatctgtt ctccgtgtgg
189661 tctcggaaca tattctcaca ccgtctcttc cgcagataaa tgcgaacccg tacccagtaa
189721 tacctttaac tatatcgatg tggaaattaa tctgtatcca gttaacgacc actaccggtc
189781 tcagcgaatc catctcaacg tcggaactaa ctattactat gaatcataaa gactgtaatc
189841 ccgtatttcg tgaggaatac ttctccgtcc ttaataaggt agcaacttca ggtttcttta
189901 caggagaaag gtgtgcactc tgaatttcga gattaaatgc aataacaaaa atttttcctc
189961 caaacagtta acgaaagcaa agaatgatga cggtatcatg ccgcattcgg agactgtcta
190021 tctagcgtcg acatctatat actatatagt aataccaata ctcaagacta cgaaactgat
190081 acaatctctt atcatgtggg taatgttctc gatgtcgata gccatatgcc cggtagttgc
190141 gatatacata aactgatcac taattccaaa cccacccgct ttttatagta agtttttcac
190201 ccataaataa taaatacaat aattaatttc tcgtaaaagt agaaaatata ttctaattta
190261 ttgcacggta aggaagtaga atcataaaga acagtactca atcaatagca atcatgaaac
190321 aatatatcgt cctggcatgc atgtgcctgc cagtcttcag caatcatcct catcctcctc
190381 ctcgtgtacg gaagaagaaa acaaacatca tatgggaatc gatgttatta tcaaagtcac
190441 aaagcaagac caaacaccga ccaatgataa gatttgccaa tccgtaacgg aaattacaga
190501 gtccgagtca gatccagatc ccgaggtgga atcagaagat gattccacat cagtcgagga
190561 tgtagatcct cctaccactt attactccat catcggtgga ggtctgagaa tgaactttgg
190621 attcaccaaa tgtcctcaga ttaaatccat ctcagaatcc gctgatggaa acacagtgaa
190681 tgctagattg tccagcgtgt ccccaggaca aggtaaggac tctcccgcga tcactcatga
190741 agaagctctg gctatgatca aagactgtga ggtgtctatc gacatcagat gtagcgaaga

FIG. 23 (CONT.)

```
190801 agagaaagac agcgacatca agacccatcc agtactcggg tctaacatct ctcataagaa
190861 agtgagttac gaagatatca tcggttcaac gatcgtcgat acaaaatgtg tcaagaatct
190921 agagtttagc gttcgtatcg gagacatgtg caaggaatca tctgaacttg aggtcaagga
190981 tggatttaag tatgtcgacg gatcggcatc tgaaggtgca accgatgata cttcactcat
191041 cgattcaaca aaactcaaag cgtgtgtctg aatcgataac tctattcatc tgaaattgga
191101 tgagtagggt taatcgaacg attcaggcac accacgaatt aaaaaagtgt accggacact
191161 atattccggt ttgcaaaaca aaaatgttct taactacatt cacaaaaagt tacctctcgc
191221 gacttcttct ttttctgtct caatagtgtg atacgattat gacactattc ctattcctat
191281 tcctatttcc tttcagggta tcacaaaaat attaaacctc tttctgatgg tctcataaaa
191341 aaagttttac aaaaatattt ttattctctt tctctctttg atggtctcat aaaaaaagtt
191401 ttacaaaaat atttttattc tctttctctc tttgatggtc tcataaaaaa agttttacaa
191461 aaatattttt attctctttc tctctttgat ggtctcataa aaaaagtttt acaaaaatat
191521 ttttattctc tttctctctt tgatggtctc ataaaaaaag ttttacaaaa atatttttat
191581 tctctttctc tctttgatgg tctcataaaa aaagttttac aaaaatattt ttattctctt
191641 tctctctttg atggtctcat aaaaaaagtt ttacaaaaat atttttattc tctttctctc
191701 tttgatggtc tcataaaaaa agttttacaa aaatattttt attctctttc tctctttgat
191761 ggtctcataa aaaatattaa acctctttct gatggtgtca ctaaaatatt tttattctca
191821 ttctcatttt ctctttctct cttcaatgga gtcataaaat atttttattc tctttctctc
191881 ttcgatggtc tcacaaaaat attaaacctc tttctgatgg tgtcactaaa atatttttat
191941 tctcattctc attttctctt tctctcttca atggagtcat aaaatatttt tattctcttt
192001 ctctcttcga tggtctcaca aaaatattaa acctctttct gatggagtcg taaaaaagtt
```

FIG. 23 (CONT.)

192061 ttatctcttt ctctcttcga tggtctcaca aaaatattaa acctctttct gatggagtcg
192121 taaaaaagtt ttatctcttt ctctcttcga tggtctcaca aaaatattaa acctctttct
192181 gatggagtcg taaaaaagtt ttatctcttt ctctcttcga tggtctcaca aaaatattaa
192241 acctctttct gatggagtcg taaaaaagtt ttatctcttt ctctcttcga tggtctcaca
192301 aaaatattaa acctctttct gatggagtcg taaaaaagtt ttatctcttt ctctcttcga
192361 tggtctcaca aaaatattaa acctctttct gatggagtcg taaaaaagtt ttatctcttt
192421 ctctcttcga tggtctcaca aaaatattaa acctctttct gatggagtcg taaaaaagtt
192481 ttatctcttt ctctcttcga tggtctcaca aaaatattaa acctctttct gatggagtcg
192541 taaaaaagtt ttatctcttt ctctcttcga tggtctcaca aaaatattaa acctctttct
192601 gatggagtcg taaaaaagtt ttatctcttt ctctcttcga tggtctcaca aaaatattaa
192661 acctctttct gatggagtcg taaaaaagtt ttatctcttt ctctcttcga tggtctcaca
192721 aaaatattaa acctctttct gatggagtcg taaaaaagtt ttatctcttt ctctcttcga
192781 tggtctcaca aaaatattaa acctctttct gatggagtcg taaaaaagtt ttatctcttt
192841 ctctcttcga tggtctcaca aaaatattaa acctctttct gatggagtcg taaaaaagtt
192901 ttatctcttt ctctcttcga tggtctcaca aaaatattaa acctctttct gatggagtcg
192961 taaaaaagtt ttatctcttt ctctcttcga tggtctcaca aaaatattaa acctctttct
193021 gatggagtcg taaaaaagtt ttatctcttt ctctcttcga tggtctcaca aaaatattaa
193081 acctctttct gatggagtcg taaaaaagtt ttatctcttt ctctcttcga tggtctcaca
193141 aaaatattaa acctctttct gatggagtcg taaaaaagtt ttatctcttt ctctcttcga
193201 tggtctcaca aaaatattaa acctctttct gatggagtcg taaaaaagtt ttatctcttt

FIG. 23 (CONT.)

193261 ctctcttcga tggtctcact aaaatatttt ttattctctt tctgatgcat caactatttc
193321 ttaaacaata acgtccaaca acatatactc gtcgagctta tcaacatccc ctatgcccat
193381 ctaggttacc agacaattgt atatcataaa ataatgttta taatttacac gttaaaatca
193441 tataataaaa cgtagatcgt ataatatttt ttggtatata aatgatctag taaaatccat
193501 gtaggggata ctgctcacat tttttctttg gtacaaaatt tcacacaagt ttttatacag
193561 acaaattctt gtccatatat tttaaaacat tgacttttgt actaagaaaa atatctagat
193621 caactatctc tttctctttc tctcttcgat ggtctcacaa aaatattaaa cctctttctg
193681 atggagtcgt aaaaaagttt tatctctttc tctcttcgat ggtctcacaa aaatattaaa
193741 cctctttctg atggagtcgt aaaaaagttt tatctctttc tctcttcgat ggtctcacaa
193801 aaatattaaa cctctttctg atggagtcgt aaaaaagttt tatctctttc tctcttcgat
193861 ggtctcacaa aaatattaaa cctctttctg atggagtcgt aaaaaagttt tatctctttc
193921 tctcttcgat ggtctcacaa aaatattaaa cctctttctg atggagtcgt aaaaaagttt
193981 tatctctttc tctcttcgat ggtctcacaa aaatattaaa cctctttctg atggagtcgt
194041 aaaaaagttt tatctctttc tccttcgatg gtctcacaaa aatattaaac ctctttctga
194101 tggagtcgta aaaaagtttt atctctttct ctcttcgatg gtctcacaaa aatattaaac
194161 ctctttctga tggagtcgta aaaaagtttt atctctttct ctcttcgatg gtctcacaaa
194221 aatattaaac ctctttctga tggagtcgta aaaaagtttt atctctttct ccttcgatgg
194281 tctcacaaaa atattaaacc tctttctgat ggagtcgtaa aaaagtttta tctctttctc
194341 cttcgatggt ctcacaaaaa tattaaacct ctttctgatg gagtcgtaaa aaagttttat
194401 ctctttctct cttcgatggt ctcacaaaaa tattaaacct ctttctgatg gagtcgtaaa

FIG. 23 (CONT.)

194461 aaagttttat ctctttctct cttcgatggt ctcacaaaaa tattaaacct ctttctgatg
194521 gtctctataa agcgatcgat ctttcttaca ctctagagtt tcctacagtc atgggtcaca
194581 catttttttc tagacactaa ataaaattag taaaattaaa ttaattataa aattatatat
194641 ataatttact aactttagtt agataaatta ataatatata agttttagta cattaatatt
194701 atattttaaa t FIG. 26
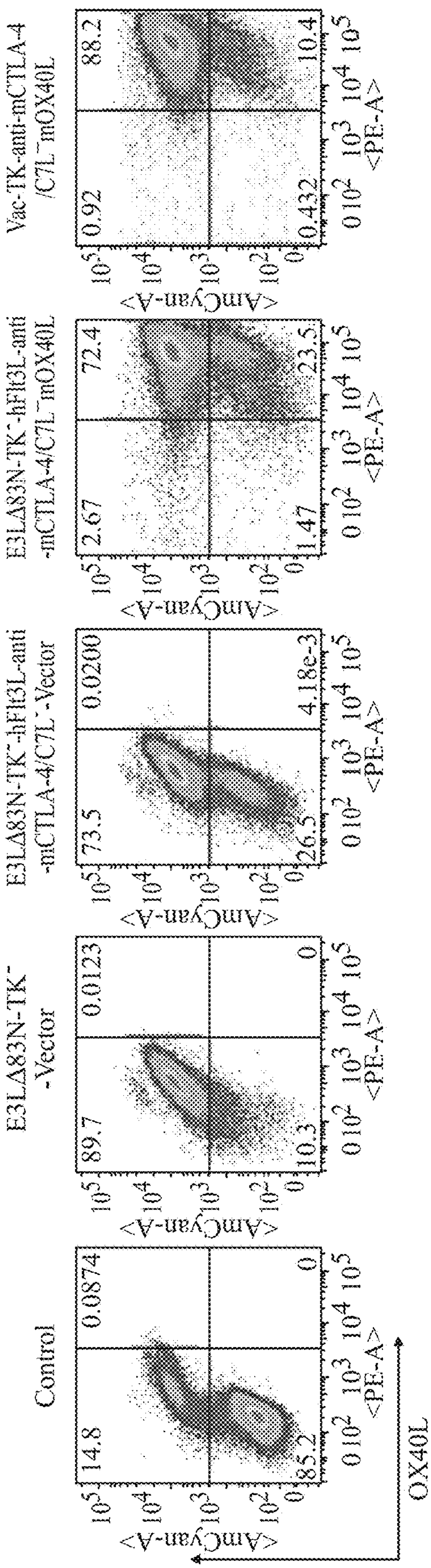
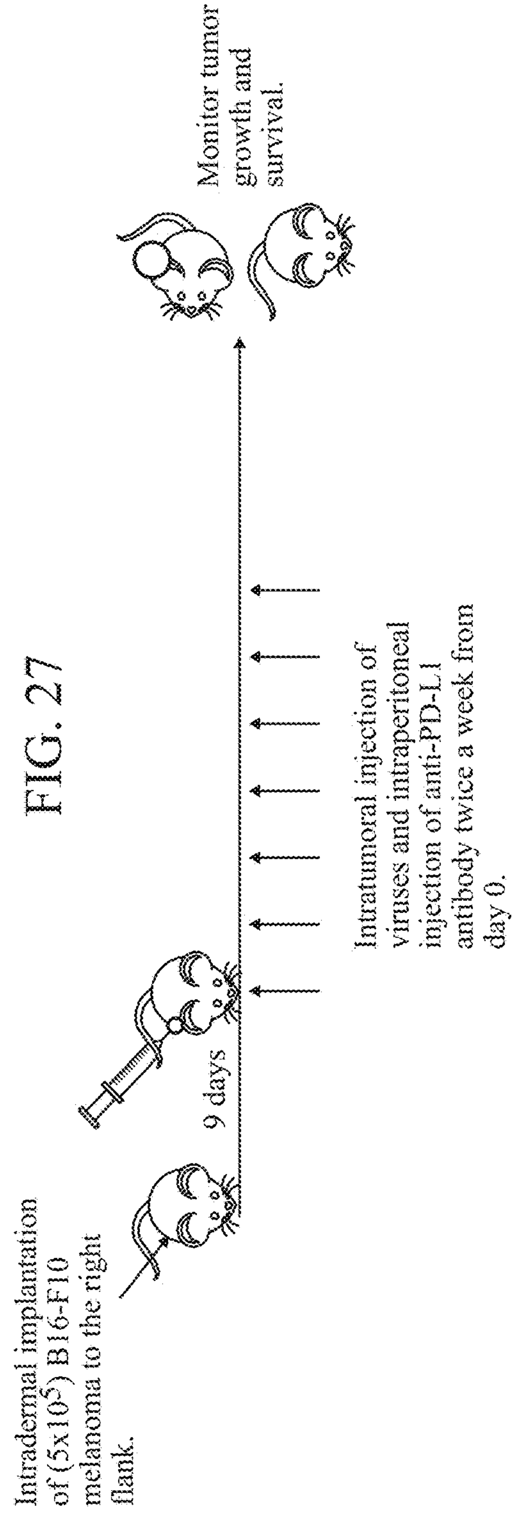
FIG. 27

FIG. 28C
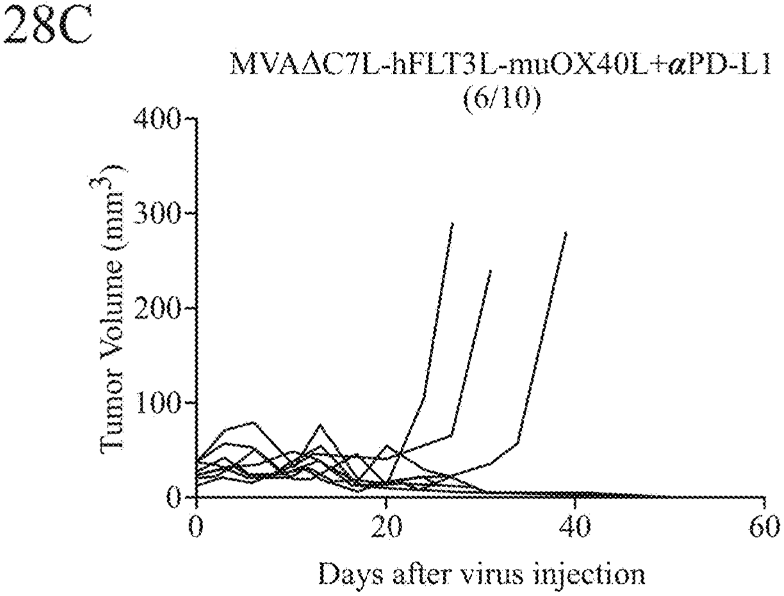
FIG. 29A
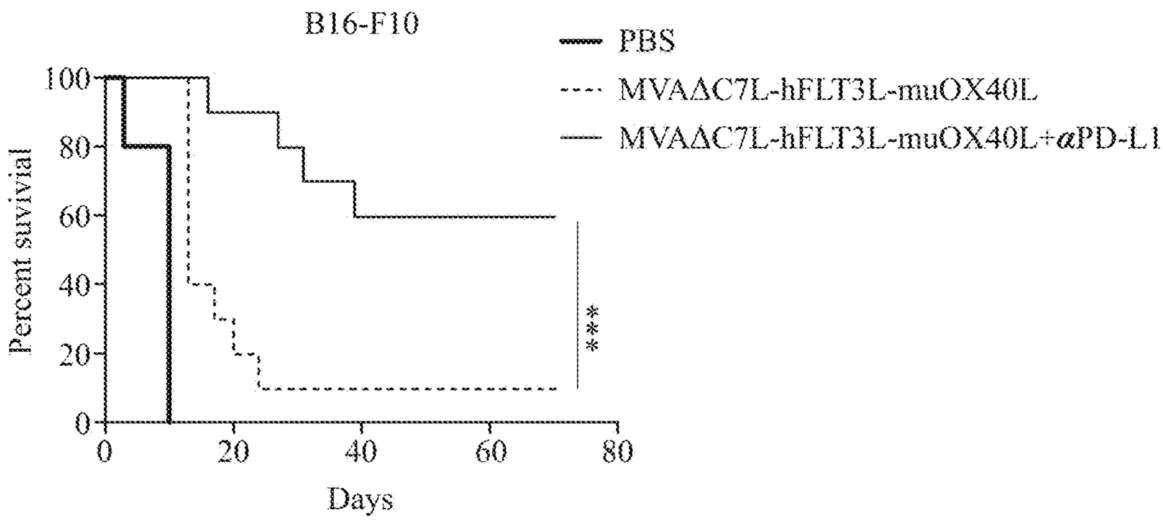
FIG. 29B
| PBS | MVAΔC7L-hFLT3L-muOX40L | MVAΔC7L-hFLT3L-muOX40L+αPD-L1 |
|---|---|---|
| 10 | 13 | Undefined |

FIG. 31C
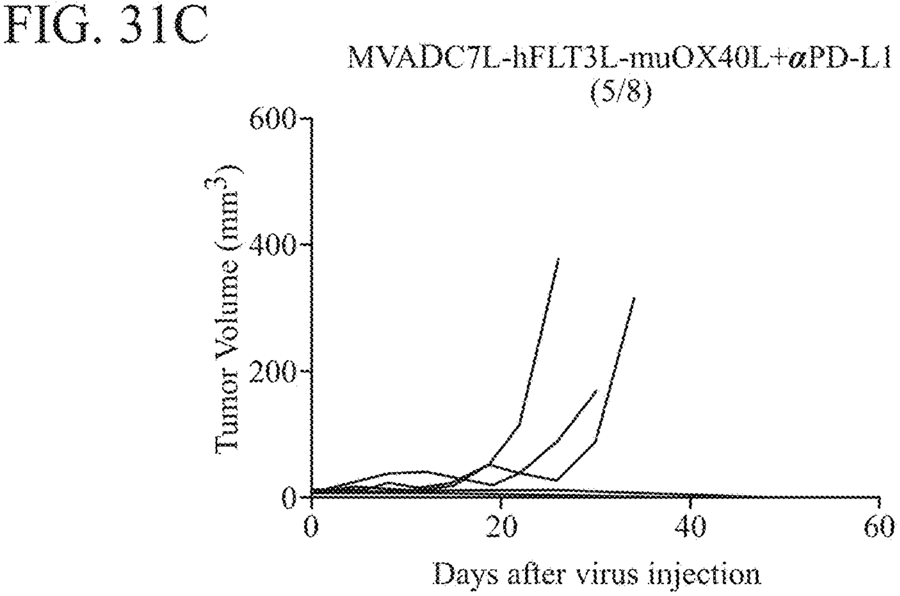
FIG. 32A
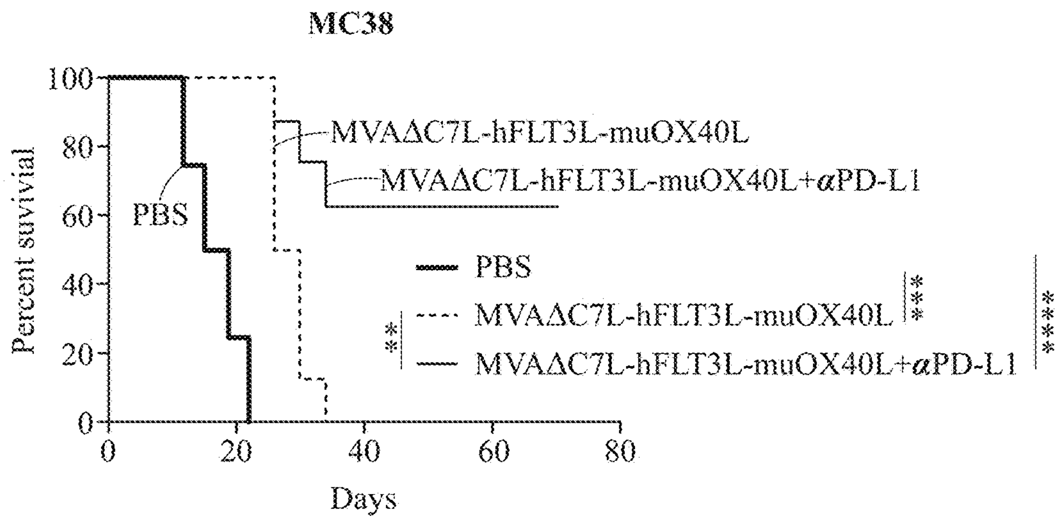
FIG. 32B
| PBS | MVAΔC7L-hFLT3L-muOX40L | MVAΔC7L-hFLT3L-muOX40L+αPD-L1 |
|---|---|---|
| 17 | 28 | Undefined |

| PBS | MVAΔC7L-hFLT3L-muOX40L | MVAΔC7L-hFLT3L-muOX40L+αPD-L1 | αPD-L1 |
|---|---|---|---|
| 13 | 23 | 43.5 | 21.5 |

P0: PBS

V1: MVAΔC7L-hFlt3L-muOX40L

C1, C2, C3: MVAΔC7L-hFLT3L-muOX40L + anti-PD-L1

R: B16-F10
L:B16-F10-OX40L

R: B16-F10
L:B16-F10-OX40L

FTY720

| Lane | Marker or PCR primer pair | Predicted band size (bp) |
|---|---|---|
| 1 | Fermentas 1kb Plus ladder | 20k, 10k, 7k, 5k, 4k, 3k, 2k, 1.5k, 1k, 700, 500, 400, 300, 200, 100, 75 |
| 2 | f0/r5 | 1120 |
| 3 | f2/r2 | 1166 |
| 4 | f5/r0 | 1136 |

Anti-hFlt3L

Anti-hOX40L

BHK Cells either mock infected (a), MVA infected (b) or MVAΔE5R-hFlt3L-hOX40L infected (c)

| Lane | PCR primer pair | Predicted band size (bp) |
|---|---|---|
| 1 | f0/r5 | 1120 |
| 2 | f1/r3 | 1171 |
| 3 | f4/r1 | 1794 |
| 4 | f1/r1 | 2795 |
| 5 | TK-F5/pCB-R4 | 2536 |

1. Control
2. E3LΔ83N-TK⁻-Vector
3. E3LΔ83N-TK⁻-hFlt3L-anti-muCTLA-4
4. E3LΔ83N-TK⁻-hFlt3L-anti-muCTLA-4-C7L⁻-mOX40L
5. VACV
6. VACV-TK⁻-anti-muCTLA-4-C7L⁻-mOX40L
7. VACV-TK⁻-anti-muCTLA-4-E5R⁻-hFlt3L-mOX40L

FIG. 87

```
Myxoma          ----------MEGDYLIRPGEKQASYACRLLGILTKHSTYPPEEYPPLVRSIMSMYNTLI 50
Yokapox         MKKYIIYSDSTMTAINMFSGESVLSYTIRLFLKLHSDDIQDVDKCLNSIRLKLSREFPEV 60
Murmansk        ------------MAMNIVPGECASTYANRLFVRLY-DENQNVSKCLNIIRSQLSSEFPEV 47
Monkeypox       ------------------------------------------------------------ 0
Akhmeta         ------------------------------------------------MSGNFGQR---- 8
Ectromelia      --------------------------MLIIVLWLYGYN--------FIMSGS--QC---- 20
Orthopoxvirus   --------------------------MLIIVLWLYGYN--------FIMSGS--QC---- 20
Cowpox          ----------------MLILTKVNIYMLIIVLWLYGYN--------FIMSGS--QC---- 30
Camelpox        --------------------------MLIIVLWLYGYN--------FIMSGS--QC---- 20
Variola         ----------------MLILTKVNIYMLIIVLWLYGYN--------FIMSGS--QC---- 30
VARV NIG69      ------------------------------------------------MSGN--QR---- 6
Buffalopox      ------------------------------------------------MSGN--QR---- 6
Horsepox        --------------------------MLIIVLWLYGYN--------FIMSES--QC---- 20
VACV-WR         ----------------MLILTKVNIYMLIIVLWLYGYN--------FIMSES--QC---- 30
VACV-Ankara     --------------------------MLIIVLWLYGYN--------FIMSGS--QC---- 20
Copenhagen      ----------------MLILTKVNIYMLIIVLWLYGYN--------FIMSGS--QC---- 30
Rabbitpox       ----------------MLILTKVNIYMLIIVLWLYGYN--------FIMSES--QC---- 30
MVA             --------------------------MLIIVLWLYGYN--------FIMSGS--QC---- 20
Raccoonpox      ------------------------------------------------MSGSPVGQFEEM 12
Skunkpox        ------------------------------------------------MSGSPVGQFEEM 12

Myxoma          KDDVIWPREIAPYLYEYTNYKQNARNPSPYISTMVVNLTTCRVSKSSAKSAKYRAKSKQH 110
Yokapox         NDNPIWNRKYVNSIYTSS---------------ACL-----------KLIMEMIQKKELE 94
Murmansk        NDDFIWWRKYVNNIYESN---------------NCR-----------SLINEYIKKTKLE 81
Monkeypox       ---HIND--D------------------------SF-----------TLKRKYQIDSAES 20
Akhmeta         --KIDNDLIR------------------------RL-----------ALKRKYQLNGEES 31
Ectromelia      --RHINDDS--------------------------F-----------TLKRKYQINSVES 41
Orthopoxvirus   --QHINDDS--------------------------F-----------TLKRKYQINSVES 41
Cowpox          --PHINNDLY------------------------RF-----------TLKRKYQINSEEL 53
Camelpox        --PHINDD--------------------------SF-----------TLKRKYQIDSAES 41
Variola         --PHINDD--------------------------RF-----------TLKRKYQIDSVES 51
VARV NIG69      --PHINDD--------------------------SF-----------TLKRKYQIDSVES 27
Buffalopox      --PHINDD--------------------------SF-----------TLKRKYQIDSVES 27
Horsepox        --PHINDD--------------------------SF-----------TLKRKYQIDSVES 41
VACV-WR         --PHINDD--------------------------SF-----------TLKRKYQIDSVES 51
VACV-Ankara     --PHINDD--------------------------SF-----------TLKRKYQIDSVES 41
Copenhagen      --PHINDD--------------------------SF-----------TLKRKYQIDSVES 51
Rabbitpox       --PHINDD--------------------------SF-----------TLKRKYQIDSVES 51
MVA             --PHINDD--------------------------SF-----------TLKRKYQIDSVES 41
Raccoonpox      DDGIGYPKLY------------------------SS-----------SLKRKYNINSEES 37
Skunkpox        DEESVYHQDH------------------------KF-----------TLKRKYNINSEET 37
```

FIG. 87 (CONT.)

```
Myxoma          KMKR-VADGVPFEEKLKRDEAIR---QKMKKDYFEIKKLYMRLKKFVRGKKSADD---NM 163
Yokapox         LME-IEKKKNIYKKKAKIIKNINEKNRLYTSHYNSLKSGYIKCLSVLMKFSRSKHVPNIP 153
Murmansk        LVK-IEKKKLLYSQKAKIIKDINANKRLSIMHYNSLKTGYIKCLSILQKITKAKYVPNID 140
Monkeypox       TMKM-DKTMTKFQNRVKMVKEINQTIRAAQTHYETLKLGYIKFKGMIRTTTLEDIAPSIP 79
Akhmeta         TTKV-DKKRTKFQNRAKMVKEINESIRVAQSHYETLKLGYIKFKRMIRTTTLKDIVTSIP 90
Ectromelia      TMKM-DKKRTKFQNRAKMVKEINQTIRAAQTHYETLKLGYIKFKRMIRTTTLEDIATSIP 100
Orthopoxvirus   TMKM-DKKRTKFQNRAKMVKEINQTIRAAQTHYETLKLGYIKFKRMIRTTTLEDMATSIP 100
Cowpox          TMKM-DKKRTKFQNRAKMVKEINQTIRAAQTHYETLKLGYIKFKRMIRTTTLEDIAPSIP 112
Camelpox        TMKM-DK-RTKFQNRAKMVKEINQTIRAAQTHYETLKLGYIKFKKMIMTTTLEDIATSIP 99
Variola         TMKM-DKKRTKFQNRAKMVKEINQTIRAAQTHYETLKLGYIKFKKMIRTTTLEDITTSIP 110
VARV NIG69      TMKM-DKKRTKFQNRAKMVKEINQTIRAAQTHYETLKLGYIKFKKMIRTTTLEDITTSIP 86
Buffalopox      TIKM-DKKRIKFQNRAKMVKEINQTIRAAQTHYETLKLGYIKFKRMIMTTTLEDIAPSIP 86
Horsepox        TIKM-DKKRIKFQNRAKMVKEINQTIRAAQTHYETLKLGYIKFKRMIMTTTLEDIAPSIP 100
VACV-WR         TIKM-DKKRTKFQNRAKMVKEINQTIRAAQTHYETLKLGYIKFKRMIRTTTLEDIAPSIP 110
VACV-Ankara     TIKM-DKKRIKFQNRAKMVKEINQTIRAAQTHYETLKLGYIKFKRMIRTTTLEDIAPSIP 100
Copenhagen      TMKM-DKKRTKFQNRAKMVKEINQTIRAAQTHYETLKLGYIKFKRMIRTTTLEDIAPSIP 110
Rabbitpox       TIKM-DKKRTKFQNRAKMVKEINQTIRAAQTHYETLKLGYIKFKRMIRTTTLEDIAPSIP 110
MVA             TIKM-DKKRTKFQNRAKMVKEINQTIRAAQTHYETLKLGYIKFKRMIRTTTLEDIAPSIP 100
Raccoonpox      NMKS-DKKKLKFQNRARLVKEVNGTIREAQLHYVSLKRGYILFKKMLKTTTLDT-ITSTP 95
Skunkpox        IMETTEKKRTKFQNRARLVKEVNGTIRAAQMHYISLKRGYIVFKKMLKTTTLDA-ITSTP 96

Myxoma          LCNKVRMIYGHINEIERVAVNEYSHAKSLLHYVFPNLFNDDKHHLFYRCTKNDGL--GVL 221
Yokapox         NIKKIVKLFSDLSTICKAAKNPKSLVYSLIHYMFPDLFGKDNRFIYYRIKPKKR-TLKQL 212
Murmansk        NFPKIIKLFYDLSTICKNSKKPTTLVYALIMYNFPDLFGNDNRFIYYRINPKRRLKIKQL 200
Monkeypox       NNQKTYKLFSDISVIGKASQNPSKHIYARCFTCFPICLEMTIDSFV-----IECIQHCS- 133
Akhmeta         NFQKVYKLFLDISAISKASQTPSKHVYALLLYMFPMLFGDDHRFIRYRHYPMSKIKHKIF 150
Ectromelia      NIQKIYKLFSDISAIGKASQNPSKHVYALLLYMFPMLFGDDHRFILYRHHPMSKIKHKIF 160
Orthopoxvirus   NIQKIYKLFSDISAIGKASQNPSKHVYALLLYMFPMLFGDDHRFILYRHHPMSKIKHKIF 160
Cowpox          NIQKTYKLFSDISAIGKASQNPSKHVYALLLYMFPMLFGDDHRFIRYRHHPMSKIKHKIF 172
Camelpox        NIQKIYKLFSDISAIGKASQNPIKHVYALLLFMFPMLFGDDHRFILYRIHPMSKIKHKIF 159
Variola         NIQKIYKLFSDISAIGKVSQNPSKHAYALLLYMFPMLFGDDHRFILYRHFPMSKIKHKIF 170
VARV NIG69      NIQKIYKLFSDISAIGKVSQNPSKHAYALLLYMFPMLFGDDHRFILYRHFPMSKIKHKIF 146
Buffalopox      NNQKTYKLFSDISAIGKASQNPSKHVYALLLYMFPMLFGDDHRFIRYRHHPMSKIKHKIF 146
Horsepox        NNQKTYKLFSDISAIGKASRNPSKHVYALLLYMFPMLFGDDHRFIRYRHHPMSKIKHKIF 160
VACV-WR         NNQKTYKLFSDISAIGKASRNPSKHVYALLLYMFPMLFGDDHRFIRYRHHPMSKIKHKIF 170
VACV-Ankara     NNQKTYKLFSDISAIGKASQNPSKHVYALLLYMFPMLFGDDHRFIRYRHHPMSKIKHKIF 160
Copenhagen      NNQKTYKLFSDISAIGKASQNPSKHVYALLLYMFPMLFGDDHRFIRYRHHPMSKIKHKIF 170
Rabbitpox       NNQKTYKLFSDISAIGKASQNPSKHVYALLLYMFPMLFGDDHRFIRYRHHPMSKIKHKIF 170
MVA             NNQKTYKLFSDISAIGKASQNPSKHVYALLLYMFPMLFGDDHRFIRYRHHPMSKIKHKIF 160
Raccoonpox      NLQKIYKLFSDISSIGNVAETPQKHVYALLIYMFPMVFGHDNRFIYYRIQPISKIKHRIF 155
Skunkpox        NFQKIYKLFFDISAISNVATSPRKHVYALLLYMFPMLFGGDNRFIHYRIQPLSKIKHRIF 156
```

FIG. 87 (CONT.)

```
Myxoma          PSKKLNLIRVILENKFKI---SKRKWTMLKKYIDTVCATGKLRVRLGTYPYYKLKSLNAL 278
Yokapox         SPFKMNLIKILVEDRFFHNKIITYTWERIRIVLDRIFDNHASINQV--DTMYKLKPLYKI 270
Murmansk        SPFKMNLIKILVEDTFFRNKILTHVWDRIRLEVDRMLDNKASNLEM--DTIYKLKPLWTI 258
Monkeypox       ------------------------------------------------------------ 133
Akhmeta         SPFKLNLIRILVEERFYNDECKYNRWRVIGSQVDKNLVAKSDKYKI--DAMYRLRPAYRI 208
Ectromelia      SPFKLNLIRILVEERFYNNECKDYRWKIIGSQVDKILIAESAKYTN--NAMYRLRPIHRI 218
Orthopoxvirus   SPFKLNLIRILVEERFYNNECKDYRWKIIGSQVDKILIAESAKYTI--DAMYRLRPIYRI 218
Cowpox          SPFKLNLIRILVEERFYNNECRDYRWRIIGTQVDKILIAESAKYTI--DAMYRLRPIYRI 230
Camelpox        SPFKLNLIRILVEERFYNNECRSNRWRIIGTQVDKHLIAESDKYTI--DARYRLRPIYRI 217
Variola         SPFKLNLIRILVEERFYNNECRSNRWRIIGTQVDKHLIAESDKYTI--DARYRLRPIYRI 228
VARV NIG69      SPFKLNLIRILVEERFYNNECRSNRWRIIGTQVDKHLIAESDKYTI--DARYRLRPIYRI 204
Buffalopox      SPFKLNLIRILVEERFYNNECRSNRWRIIGTQVDKHLIAESDKYTI--DARYNLKPHYRI 204
Horsepox        SPFKLNLIRILVEERFYNNECRSNKWRIIGTQVDKHLIAESDNYTI--DARYNLKPHYRI 218
VACV-WR         SPFKLNLIRILVEERFYNNECRSNKWRIIGTQVDKHLIAESDKYTI--DARYNLKPHYRI 228
VACV-Ankara     SPFKLNLIRILVEERFYNNECRSNKWRIIGTQVDKHLIAESDNYTI--DARYNLKPHYRI 218
Copenhagen      SPFKLNLIRILVEERFYNNECRSNKWRIIGTQVDKHLIAESDKYTI--DARYNLKPHYRI 228
Rabbitpox       SPFKLNLIRILVEERFYNNECRSNKWRIIGTQVDKHLIAESDKYTI--DARYNLKPHYRI 228
MVA             SPFKLNLIRILVEERFYNNECRSNKWRIIGTQVDKHLIAESDKYTI--DARYNLKPHYRI 218
Raccoonpox      SPFKLNLIRILVEERFYNNESKFRKWKAIGTQVDKHLAAESAKYKI--NEMYRLRSHHRI 213
Skunkpox        SPFKINLIRILVEERFYNNESKYRRWKHIGSQVDKHLAAESAKCTV--DTMYRLRPIHRI 214

Myxoma          VASYQGDSVDELKTLVLSSFSLVDLTEKLIKTTFPEVVKSGEGHNYRCYPDGT--HQGLD 336
Yokapox         KIKNEND-KAFIKEIVSECITTQELVEKVLKRLFVDIFKDGSYTSTRHDSD-DNEYIPLD 328
Murmansk        YVKDEND-KEFIKDMARECISTQELLEKTLKKLFTDMFKDGSYKMYRHDAD-D-KYMGLD 315
Monkeypox       ------------------------------------------------------------ 133
Akhmeta         KGNSEED-TLFIKQIVEKCVTSQELVEKVLKMLFTDLFKSGEYKMYRHDADAENGFIGLD 267
Ectromelia      KVESEED-TLFIKQMVEKCVTSQELVEKVLKILFRDLFKSGEYKAYRYDDDVENGFIGLD 277
Orthopoxvirus   KVESEED-TLFIKQMVEKCVTSQELVEKVLKILFRDLFKSGEYKAYRYEDDAEKGFIGLD 277
Cowpox          KVESEED-TLFIKQMVEQCVTSQELVEKVLKILFRDLFKSGEYKAYRYDDDVDNGFIGLD 289
Camelpox        KGESEED-TLFIKQMVEQCVTSQELVEKVLKILFRDLFKSGEYKAYRYD-DVENVFIGLD 275
Variola         KGKSEED-TLFIKQMVDQCVTSQELVEKVLKILFRDLFKSGEYKAYRYDDDVENGFIGLD 287
VARV NIG69      KGESEED-TLFIKQMVEQCVTSQELVEKVLKILFRDLFKSGEYKAYRYDDDVENGFIGLD 263
Buffalopox      KGESEED-TLFIKQMVEQCVTSQELVEKVLKILFRDLFKSGEYKAYRYDDDVENGFIGLD 263
Horsepox        KGESEED-TLFIKQMVEQCVTSQELVEKVLKILFRDLFKSGEYKAYRYDDDVENGFIGLD 277
VACV-WR         KGKSEED-TLFIKQMVEQCVTSQELVEKVLKILFRDLFKSGEYKAYRYDDDVENGFIGLD 287
VACV-Ankara     KGESEED-TLFIKQMVEQCVTSQELVEKVLKILFRDLFKSGEYKAYRYDDDVENGFIGLD 277
Copenhagen      KGESEED-TLFIKQMVEQCVTSQELVEKVLKILFRDLFKSGEYKAYRYDDDVENGFIGLD 287
Rabbitpox       KGESEED-TLFIKQMVEQCVTSQELVEKVLKILFRDLFKSGEYKAYRYDDDVENGFIGLD 287
MVA             KGESEED-TLFIKQMVEQCVTSQELVEKVLKILFRDLFKSGEYKAYRYDDDVENGFIGLD 277
Raccoonpox      KTDSEED-TLFIKHMAEKCSTSQELVEKVLKILFRDLFKSGDYKLYRHDDDVENGFIGLD 272
Skunkpox        KTDSEED-TLFIKQIAEKCSTSQELVEKVLKILFTDLFKSGDYKVFRHDEDAENGFIGLD 273
```

FIG. 87 (CONT.)

```
Myxoma          PR------RVIDMCYKARVATDSESVVDVHNAIVETVNRFLIRSEKKVGDNIDECIVMAX 390
Yokapox         KIKLEIVHSIVDPCIYAPKHMSY-------LICREMINKYFENPTHIIGKNIQECVEIAK 381
Murmansk        KIKLDIIHRIVDPCIIAPKRIAY-------LICKDMINNYFEKPTHIIGSNIQKCIDIKL 368
Monkeypox       ------------------------------------------------------------ 133
Akhmeta         KIKLNIVHDIVEPCMPVRRSLAR-------AQCKEMVNKYFENPLHILGKNLQECIDFVS 320
Ectromelia      KLKLNIVHDIVEPCMPVRRPVAK-------ILCKEMVNKYFENPLHILGKNLQECIDFVS 330
Orthopoxvirus   KLKLNIVHYIVEPCMPVRRPVAK-------ILCKEMVNKYFENPLHILGKNLQECIDFVS 330
Cowpox          KLKLNIVHNIVEPCMPVRRPVAK-------ILCKEMVNKYFENPLHILGKNLQECIDFVS 342
Camelpox        KLKLNILHDIVEPCMPVRRPVAK-------ILCKEMVNKYFENPLHILGKNLQECIDFVS 328
Variola         KLKLNIVHDIVEPCMPVRRPVAK-------ILCKEMVNKYFENPLHILGKNLQECIDFVS 340
VARV_NIG69      KLKLNIVHDIVEPCMPVRRPVAK-------ILCKEMVNKYFENPLHILGKNLQECIDFVS 316
Buffalopox      TLKLNIVHDIVEPCMPVRRPVAK-------ILCKEMVNKYFENPLHILGKNLQECIDFVS 316
Horsepox        TLKLNIVHDIVEPCMPVRRPVAK-------ILCKEMVNKYFENPLHILGKNLQECIDFVS 330
VACV-WR         TLKLNIVHDIVEPCMPVRRPVAK-------ILCKEMVNKYFENPLHILGKNLQECIDFVS 140
VACV-Ankara     TLKLNIVHDIVEPCMPVRRPVAK-------ILCKEMVNKYFENPLHILGKNLQECIDFVS 330
Copenhagen      TLKLNIVHDIVEPCMPVRRPVAK-------ILCKEMVNKYFENPLHILGKNLQECIDFVS 340
Rabbitpox       TLKLNIVHDIVEPCMPVRRPVAK-------ILCKEMVNKYFENPLHILGKNLQECIDFVS 340
MVA             TLKLNIVHDIVEPCMPVRRPVAK-------ILCKEMVNKYFENPLHILGKNLQECIDFVS 330
Raccoonpox      KIKLDIVHEIVEPCMTGSRTLAS-------APCKEMINKYFENPLHILGKNLQECIEIAR 325
Skunkpox        KIKLNIVHEIVEPCLSVHRSLAR-------APCKEMVNKYFENPLHILGKNLQECIDFVR 326

Myxoma          TIN  393
Yokapox         KST  384
Murmansk        ---  368
Monkeypox       ---  133
Akhmeta         E--  321
Ectromelia      E--  331
Orthopoxvirus   E--  331
Cowpox          E--  343
Camelpox        E--  329
Variola         E--  341
VARV_NIG69      E--  317
Buffalopox      E--  317
Horsepox        E--  331
VACV-WR         E--  341
VACV-Ankara     E--  331
Copenhagen      E--  341
Rabbitpox       E--  341
MVA             E--  331
Raccoonpox      S--  326
Skunkpox        S--  327
```

FIG. 88A

```
VACV-WR    MLILTKVNIYMLIIVLWLYGYNFIISESQCPMINDDSFTLKRKYQIDSAESTIKMDKKRT    60
MVA        ----------MLIIVLWLYGYNFIMSGSQCPMINDDSFTLKRKYQIDSAESTIKMDKKRT    50
                     **************:* *********************************

VACV-WR    KFQNRAKMVKEINQTIRAAQTHYETLKLGYIKFKRMIRTTTLEDIAPSIPNNQKTYKLFS    120
MVA        KFQNRAKMVKEINQTIRAAQTHYETLKLGYIKFKRMIRTTTLEDIAPSIPNNQKTYKLFS    110
           ************************************************************

VACV-WR    DISAIGKASRNPSKMVYALLLYMFPNLFGDDHRFIRYRMHPMSKIKHKIFSPFKLNLIRI    180
MVA        DISAIGKASQNPSKMVYALLLYMFPNLFGDDHRFIRYRMHPMSKIKHKIFSPFKLNLIRI    170
           *********:**************************************************

VACV-WR    LVEERFYNNECRSNKWRIIGTQVDKMLIAESDKYTIDARYNLKPMYRIKGKSEEDTLFIK    240
MVA        LVEERFYNNECRSNKWRIIGTQVDKMLIAESDKYTIDARYNLKPMYRIKGKSEEDTLFIK    230
           ************************************************************

VACV-WR    QMVEQCVTSQELVEKVLKILFRDLFKSGEYKAYRYDDDVENGFIGLDTLKLNIVHDIVEP    300
MVA        QMVEQCVTSQELVEKVLKILFRDLFKSGEYKAYRYDDDVENGFIGLDTLKLNIVHDIVEP    290
           ************************************************************

VACV-WR    CMPVRRPVAKILCKEMVNKYFENPLHIIGKNLQECIDFVSE    341
MVA        CMPVRRPVAKILCKEMVNKYFENPLHIIGKNLQECIDFVSE    331
           *****************************************
```

FIG. 88B

```
VACV        ----------------------------------------------MLILTKVNIYMLII    14
myxoma      MEGDYLIRPGEKQASYACRLLGILTKHSTYPPEEYFPLVRSIMSMYNTLIKDDVIWFREI    60
                                                            ::..  *::  *

VACV        VLWLYGYNFIISESQCPMINDD--SFT-----------LKRKYQIDSAESTIKMDKKRTK    61
myxoma      APYLYEYTMYKQNARNPSFYISTNVVNLTTCRVSKSSAKSAKYRAKSKQMKMRRVADGVP    120
            . :** *.:  .::: * :  .   ..            . **: .* : .::   . .

VACV        FQNRAKMVKEINQTIRAAQTHYETLKLGYIKFKRMIRTTTLEDIAPSIPNNQKTYKLFSD    121
myxoma      FEEKLKRDEAIR---QKNKKDYFELKKLYMRLKKFVRGKKSADDNM---LCNKVRMLYGH    174
            *::: *  : *.   :  :..*  :*  *:::*:::* ..  *        :*.  ::..

VACV        ISAIGKASRNPSKMVYALLLYMFPNLFGDDHRFIRYRMHPMSKIKHKIFSPFKLNLIRIL    181
myxoma      INEIERVAVNEYSMAKSLLHYVFPNLFNDDKHHLFYRCTKMDGLG--VLPSKKLNLIRVI    232
            *. * :.: *  .*. :** *:*****.**::.: **   *. :   ::   ******::

VACV        VEERFYNNECRSNKWRIIGTQVDKMLIAESDKYTIDARYNLKPMYRIKGKSEED------    235
myxoma      LENKFKI---SKRKWTMLKKYIDTVCATGK----LRVRLGTYPYYKLKSLNALVASYQGD    285
            :*::*      ..** :: . :*.:  : .    : .* .  * *::*. .

VACV        -TLFIKQMVEQCVTSQELVEKVLKILFRDLFKSGEYKAYRYDDDVENGFIGLDTLKLNIV    294
myxoma      SVDELKTLVLSSFSLQDLTEKLIKTTFPEVVKSGEGHNYRCYPDGTH--QGLDPER----    339
             .* :* :* ...:  :*.**::*  * ::.**** : **   *  :   ***  :

VACV        HDIVEPCMPVRRPVA-------KILCKEMVNKYFENPLHIIGKNLQECIDFVSE--    341
myxoma      --VIDMCYKARVATDSESVVDVHNAIVETVNRFLIRSEKKVGDNIDECIVMAKTIN    393
              ::: *  .*  .        :    * **::: .  : :*.*::*** :..
```

| PBS | MVA | MVAΔE5R | MVA |
|---|---|---|---|
| 11 | 26 | Undefined | Undefined |

FIG. 1117A
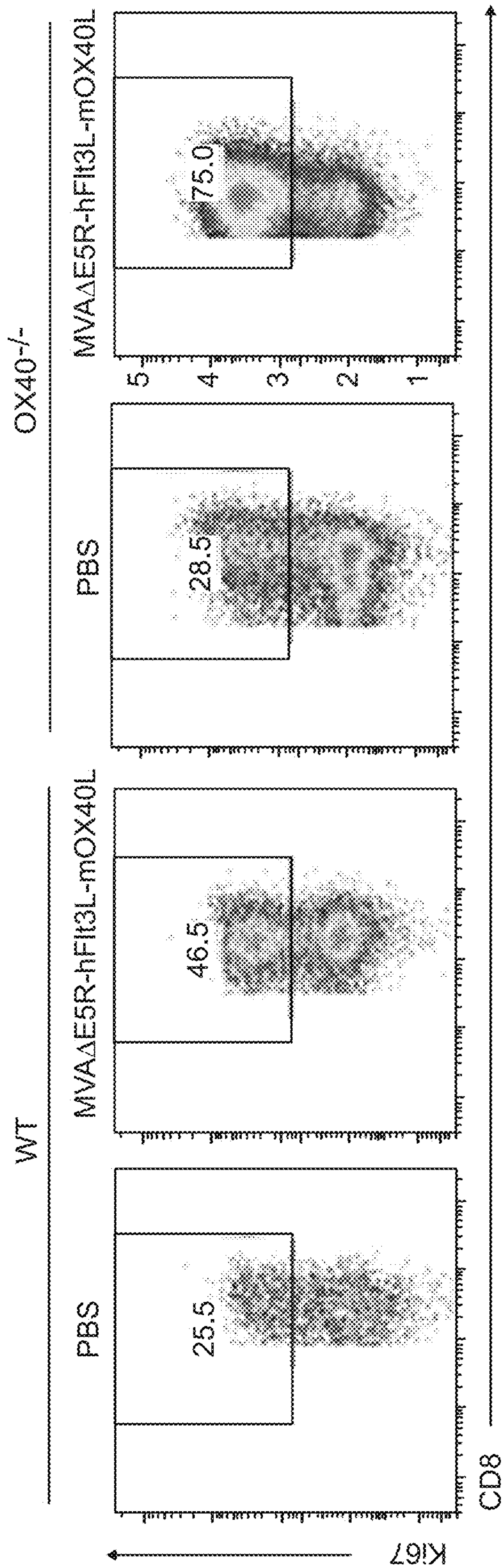

FIG. 1117C
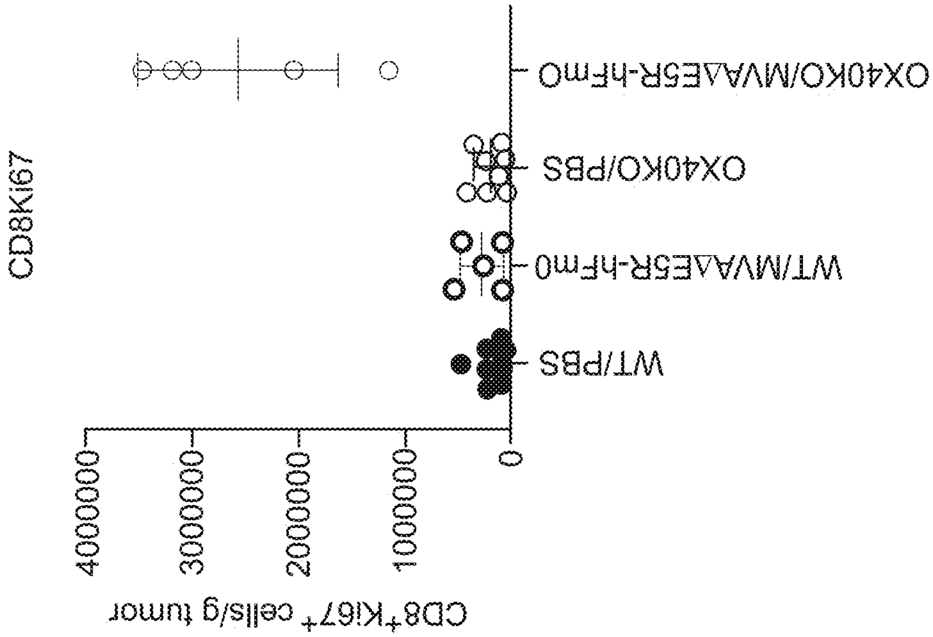
FIG. 1117B
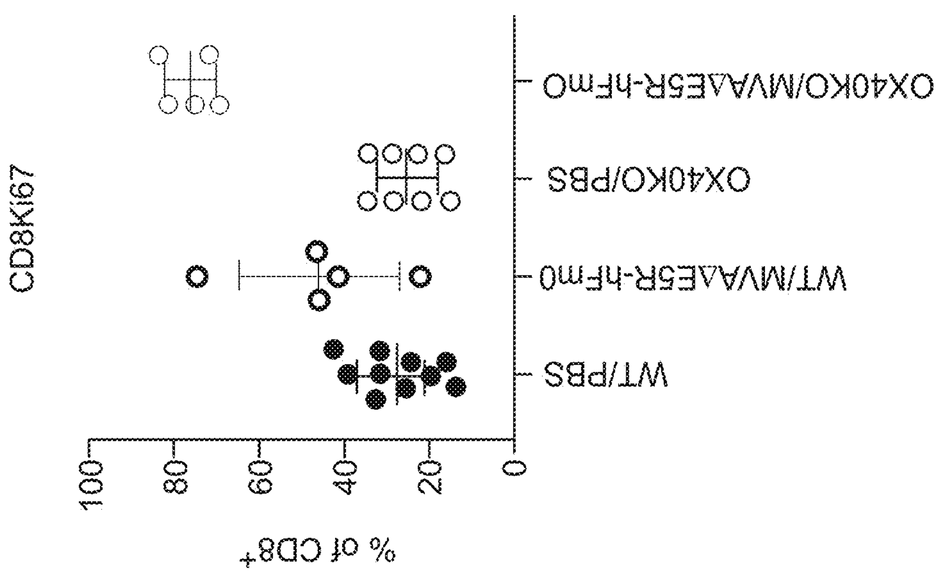

VACVΔB2R-H: 2x10$^7$ pfu/20ul

VACVΔB2R-L: 2x10$^6$ pfu/20ul

OV-VACV–ΔE5R: VACVΔE3L83N-ΔTK-anti-muCTLA-4-ΔE5R-hFlt3L-mOX40L-mIL-12

OV-VACV–ΔE5RΔB2R: VACVΔE3L83N-ΔTK-anti-muCTLA-4-ΔE5R-hFlt3L-mOX40L-mIL-12ΔB2R

OV-VACV−ΔE5R: VACVΔE3L83N-ΔTK-anti-muCTLA-4-ΔE5R-hFlt3L-mOX40L-mIL-12

OV-VACV−ΔE5RΔB2R: VACVΔE3L83N-ΔTK-anti-muCTLA-4-ΔE5R-hFlt3L-mOX40L-mIL-12ΔB2R

OV-VACV–ΔE5R: VACVΔE3L83N-ΔTK-anti-muCTLA-4-ΔE5R-hFlt3L-mOX40L-mIL-12

OV-VACV–ΔE5RΔB2R: VACVΔE3L83N-ΔTK-anti-muCTLA-4-ΔE5R-hFlt3L-mOX40L-mIL-12ΔB2R

RECOMBINANT POXVIRUSES FOR CANCER IMMUNOTHERAPY

CROSS-REFERENCE TO RELATED APPLICATIONS

This application is a US National Phase Application under 37 U.S.C. § 371 of International Application No. PCT/US2019/051343, filed on Sep. 16, 2019, which claims the benefit of and priority to U.S. Provisional Application No. 62/731,876, filed Sep. 15, 2018, U.S. Provisional Application No. 62/767,485, filed Nov. 14, 2018, and U.S. Provisional Application No. 62/828,975, filed Apr. 3, 2019, the disclosures of which are incorporated by reference herein in their entireties.

STATEMENT OF FEDERALLY FUNDED RESEARCH

This invention was made with government support under AI073736, AI095692, AR068118, and CA008748 awarded by the National Institutes of Health. The government has certain rights in the invention.

SEQUENCE LISTING

The instant application contains a Sequence Listing which has been submitted electronically in ASCII format and is hereby incorporated by reference in its entirety. Said ASCII copy, created on Jun. 23, 2023, is named 115872-2159_SL.txt and is 688,356 bytes in size.

TECHNICAL FIELD

The technology of the present disclosure relates generally to the fields of oncology, virology, and immunotherapy. In particular, the present technology relates to the use of poxviruses, including a recombinant modified vaccinia Ankara (MVA) virus comprising a deletion of E3L (MVAΔE3L) genetically engineered to express OX40L (MVAΔE3L-OX40L); a recombinant MVA virus comprising a deletion of C7L (MVAΔC7L) genetically engineered to express OX40L (MVAΔC7L-OX40L); a recombinant MVAΔC7L engineered to express OX40L and hFlt3L (MVAΔC7L-hFlt3L-OX40L); a recombinant MVA genetically engineered to comprise a deletion of C7L, a deletion of E5R, and to express hFlt3L and OX40L (MVAΔC7LΔE5R-hFlt3L-OX40L); a recombinant MVA genetically engineered to comprise a deletion of E5R (MVAΔE5R); a recombinant MVA genetically engineered to comprise a deletion of E5R and to express hFlt3L and OX40L (MVAΔE5R-hFlt3L-OX40L); a recombinant MVA genetically engineered to comprise a deletion of E3L, a deletion of E5R, and to express hFtl3L and OX40L (MVAΔE3LΔE5R-hFlt3L-OX40L); a recombinant MVA genetically engineered to comprise a deletion of E5R, a deletion of C11R, and to express hFlt3L and OX40L (MVAΔE5R-hFlt3L-OX40L-ΔC11R); a recombinant MVA genetically engineered to comprise a deletion of E3L, a deletion of E5R, a deletion of C11R, and to express hFlt3L and OX40L (MVAΔE3LΔE5R-hFlt3L-OX40L-ΔC11R); a recombinant vaccinia virus comprising a deletion of C7L (VACVΔC7L) genetically engineered to express OX40L (VACVΔC7L-OX40L); a recombinant VACVΔC7L genetically engineered to express both OX40L and hFlt3L (VACVΔC7L-hFlt3L-OX40L); a VACV genetically engineered to comprise a deletion of E5R (VACVΔE5R); a recombinant VACV genetically engineered to comprise a deletion of E5R, a deletion of thymidine kinase (TK), and to express anti-CTLA-4, hFlt3L, and OX40L (VACV-TK$^-$-anti-CTLA-4-ΔE5R-hFlt3L-OX40L); a VACV genetically engineered to comprise a deletion of B2R (VACVΔB2R); a VACV genetically engineered to comprise an E3LΔ83N deletion and a B2R deletion (VACVE3LΔ83NΔB2R); a VACV genetically engineered to comprise an E5R deletion and a B2R deletion (VACVΔE5RΔB2R); a VACV genetically engineered to comprise an E3LΔ83N deletion, an E5R deletion, and a B2R deletion (VACVE3LΔ83NΔE5RΔB2R); a VACV genetically engineered to comprise an E3LΔ83N deletion, a deletion of thymidine kinase (TK), and an E5R deletion, and expressing anti-CTLA-4, hFlt3L, OX40L, and IL-12 (VACVE3LΔ83N-ΔTK-anti-CTLA-4-ΔE5R-hFlt3L-OX40L-IL-12); a VACV genetically engineered to comprise an E3LΔ83N deletion, a deletion of thymidine kinase (TK), an E5R deletion, and a B2R deletion, and expressing anti-CTLA-4, hFlt3L, OX40L, and IL-12 (VACVE3LΔ83N-ΔTK-anti-CTLA-4-ΔE5R-hFlt3L-OX40L-IL-12-ΔB2R); a MYXV genetically engineered to comprise a deletion of M31R (MYXVΔM31R); a recombinant MYXV genetically engineered to comprise a deletion of M31R and to express hF13L and OX40L (MYXVΔM31R-hFlt3L-OX40L); a MYXV genetically engineered to comprise a deletion of M63R (MYXVΔM63R); a MYXV genetically engineered to comprise a deletion of M64R (MYXVΔM64R); an MVA genetically engineered to comprise a deletion of WR199 (MVAΔWR199); an MVA genetically engineered to comprise a deletion of E5R, a deletion of WR199, and expressing hFlt3L and OX40L (MVAΔE5R-hFlt3L-OX40L-ΔWR199); or combinations thereof, alone or in combination with immune checkpoint blocking agents, immunomodulatory agents, and/or anti-cancer drugs as an immunotherapeutic and/or oncolytic composition. In some embodiments, the technology of the present disclosure relates to any one of the foregoing viruses further modified to express a specific gene of interest (SG), such as genes encoding any one or more of the following immunomodulatory proteins, including but not limited to hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L. In some embodiments, the virus backbones are further modified to comprise deletions or mutations of genes, including but not limited to thymidine kinase (TK), E3L (ΔE3L), E3LΔ83N, B2R (ΔB2R), B19R (B18R; ΔWR200), E5R, K7R, C12L (IL18BP), B8R, B14R, N1L, C11R, K1L, M1L, N2L, and/or WR199. In some embodiments, the technology of the present disclosure relates to the use of any one of the foregoing viruses as a vaccine adjuvant. In particular, the present technology relates to the use of MVAΔC7L-hFlt3L-TK(−)-OX40L, MVAΔE5R-hFlt3L-OX40L, MVAΔC7LΔE5R-hFlt3L-OX40L, and Heat-inactivated MVAΔE5R as a vaccine adjuvant for tumor antigens in cancer vaccines alone or in combination with immune checkpoint blockade (ICB) antibodies for use as a cancer immunotherapeutic. In some embodiments, the technology of the present disclosure relates to the use of any one of the foregoing viruses as a vaccine vector. In particular, the present technology relates to the use of MVAΔE5R or MVAΔE5R-hFlt3L-OX40L as vaccine vectors for cancer vaccines. In some embodiments, the present technology relates to a recombinant poxvirus selected from MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-

OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3L-ΔE5R-hFlt3L-mOX40LΔWR199-hIL-12ΔC11R-hIL-15/IL-15α, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64R-ΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-CTLA-4, and MYXVΔM62RΔM63RΔM64RΔM31R-hFlt3L-OX40L-IL-12-IL-15/IL-15Rα-CTLA-4, or combinations thereof, alone or in combination with immune checkpoint blocking agents, immunomodulatory agents, and/or anti-cancer drugs as an immunotherapeutic and/or oncolytic composition.

BACKGROUND

The following description is provided to assist the understanding of the reader. None of the information provided or references cited is admitted to be prior art.

Malignant tumors such as melanoma are inherently resistant to conventional therapies and present significant therapeutic challenges. Immunotherapy is an evolving area of research and an additional option for the treatment of certain types of cancers. The immunotherapy approach rests on the rationale that the immune system may be stimulated to identify tumor cells and target them for destruction. Despite presentation of antigens by cancer cells and the presence of immune cells that could potentially react against tumor cells, in many cases, the immune system is not activated or is affirmatively suppressed. Key to this phenomenon is the ability of tumors to protect themselves from immune response by coercing cells of the immune system to inhibit other cells of the immune system. Tumors develop a number of immunomodulatory mechanisms to evade antitumor immune responses. Thus, improved immunotherapeutic approaches are needed to enhance host antitumor immunity and target tumor cells for destruction.

SUMMARY

In one aspect, the present disclosure provides a recombinant modified vaccinia Ankara (MVA) virus comprising a mutant C7 gene and a heterologous nucleic acid molecule encoding OX40L (MVAΔC7L-OX40L). In some embodiments, the recombinant MVAΔC7L-OX40L virus further comprises a heterologous nucleic acid encoding human Fms-like tyrosine kinase 3 ligand (hFlt3L) (MVAΔC7L-hFlt3L-OX40L). In some embodiments, the recombinant MVAΔC7L-OX40L virus of the present technology further comprises a mutant thymidine kinase (TK) gene. In some embodiments, the recombinant MVAΔC7L-OX40L virus comprising the mutant TK gene comprises replacement of at least a portion of the gene with one or more gene cassettes comprising a heterologous nucleic acid molecule. In some embodiments, the one or more gene cassettes comprise the heterologous nucleic acid molecule encoding OX40L. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid molecule. In some embodiments, the one or more gene cassettes comprise a heterologous nucleic acid molecule encoding hFlt3L. In some embodiments, the mutant C7 gene comprises replacement of at least a portion of the gene with one or more gene cassettes comprising the heterologous nucleic acid molecule encoding hFlt3L, and wherein the virus further comprises a mutant TK gene comprising replacement of at least a portion of the TK gene with one or more gene cassettes comprising the heterologous nucleic acid molecule encoding OX40L (MVAΔC7L-hFlt3L-TK(−)-OX40L). In some embodiments, the OX40L is expressed from within a MVA viral gene. In some embodiments, the OX40L is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the OX40L is expressed from within the TK gene. In some embodiments, the OX40L is expressed from within the TK gene and the hFlt3L is expressed from within the C7 gene. In some embodiments, the virus further comprises a heterologous nucleic acid molecule encoding one or more of hIL-2, hIL-12, hIL-15, hIL-15/IL-15RΔ, hIL-18, hIL-21, anti-huCTLA-4, anti-huPD-1, anti-huPD-L1, GITRL, 4-1BBL, or CD40L, and/or a deletion of any one or more of E3L (ΔE3L), E3LΔ83N, B2R (ΔB2R), B19R (B18R; ΔWR200), IL18BP, E5R, K7R, C12L, B8R, B14R, N1L, C11R, K1L, M1L, N2L, or WR199. In some embodiments, the recombinant MVA virus exhibits one or more of the following characteristics: induction of increased levels of effector T-cells in tumor cells as compared to tumor cells infected with the corresponding MVAΔC7L virus; induction of increased splenic production of effector T-cells as compared to the corresponding MVAΔC7L virus; and reduction of tumor volume in tumor cells contacted with the recombinant MVAΔC7L-OX40L virus as compared to tumor cells contacted with the corresponding MVAΔC7L virus. In some embodiments, the tumor cells comprise melanoma cells.

In another aspect, the present disclosure provides, an immunogenic composition comprising the recombinant MVAΔC7L-OX40L virus of the present technology. In some embodiments, the immunogenic composition further comprises a pharmaceutically acceptable carrier. In some embodiments, the immunogenic composition of the present technology comprises a pharmaceutically acceptable adjuvant.

In another aspect, the present disclosure provides a method for treating a solid tumor in a subject in need thereof, the method comprising delivering to a tumor a composition comprising an effective amount of the recombinant MVAΔC7L-the present technology. In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments, the method for treating a solid tumor in a subject in need thereof comprises the induction, enhancement, or promotion of the immune response comprises one or more of the following: increased levels of effector T-cells in tumor cells as compared to tumor cells infected with the corresponding MVAΔC7L virus; and increased splenic production of effector T-cells as compared to the corresponding MVAΔC7L virus. In some embodiments, the method of treating a solid tumor in a subject in need thereof the composition is administered by intratumoral or intravenous injection or a simultaneous or sequential combination of intratumoral and intravenous injection. In some embodiments of the method of treating a solid tumor in a subject in need thereof, the tumor is melanoma, colon, breast, bladder, or prostate carcinoma. In some embodiments of the method of treating a solid tumor in a subject in need thereof, the composition comprises one or more immune checkpoint blocking agents. In some embodiments of the method of treating a solid tumor in a subject in need thereof, the method further comprises administering to the subject one or more immune checkpoint blocking agents. In some embodiments of the method of treating a solid tumor in a subject in need thereof, the one or more immune checkpoint blocking agent is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments of the method of treating a solid tumor in a subject in need thereof, the one or more immune checkpoint blocking agents comprises anti-PD-1 antibody. In some embodiments of the method of treating a solid tumor in a subject in need thereof, the one or more immune checkpoint blocking agents comprises anti-PD-L1 antibody. In some embodiments of the method of treating a solid tumor in a subject in need thereof, the one or more immune checkpoint blocking agents comprises anti-CTLA-4 antibody. In some embodiments of the method of treating a solid tumor in a subject in need thereof, the combination of the MVAΔC7L-OX40L or MVAΔC7L-hFlt3L-OX40L and the immune checkpoint blocking agent has a synergistic effect in the treatment of the tumor as compared to administration of either the MVAΔC7L-OX40L or MVAΔC7L-hFlt3L-OX40L or of the immune checkpoint blocking agent alone.

In another aspect, the present disclosure provides a method of stimulating an immune response comprising administering to a subject an effective amount of the virus of the present technology (e.g., MVAΔC7L-OX40L, MVAΔC7L-hFlt3L-OX40L) or an immunogenic composition of the present technology. In some embodiments, the method further comprises administering to the subject one or more immune checkpoint blocking agents. In some embodiments, the one or more immune checkpoint blocking agents is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments, the one or more immune checkpoint blocking agents comprises anti-PD-1 antibody. In some embodiments, the one or more immune checkpoint blocking agents comprises anti-PD-L1 antibody. In some embodiments, the one or more immune checkpoint blocking agents comprises anti-CTLA-4 antibody.

In another aspect, the present disclosure provides, a recombinant modified vaccinia Ankara (MVA) virus comprising a mutant E3 gene and a heterologous nucleic acid molecule encoding OX40L (MVAΔE3L-OX40L). In some embodiments, the recombinant MVAΔE3L-OX40L virus comprises a mutant thymidine kinase (TK) gene. In some embodiments, the mutant TK gene comprises replacement of at least a portion of the gene with one or more gene cassettes comprising a heterologous nucleic acid molecule. In some embodiments, the one or more gene cassettes comprise the heterologous nucleic acid molecule encoding OX40L. In some embodiments of the virus of the present technology, the OX40L is expressed from within a MVA viral gene. In some embodiments of the virus of the present technology, the OX40L is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, of the virus of the present technology, the OX40L is expressed from within the TK gene. In some embodiments, of the virus of the present technology, the virus comprises a heterologous nucleic acid molecule encoding one or more of hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of E3LΔ83N, B2R (ΔB2R), B19R (B18R; ΔWR200), E5R, K7R, C12L (IL18BP), B8R, B14R, N1L, C11R, K1L, M1L, N2L, or WR199. In some embodiments, of the virus of the present technology, the recombinant MVA virus exhibits one or more of the following characteristics: induction of increased levels of effector T-cells in tumor cells as compared to tumor cells infected with the corresponding MVAΔE3L virus; induction of increased splenic production of effector T-cells as compared to the corresponding MVAΔE3L virus; and reduction of tumor volume in tumor cells contacted with the recombinant MVAΔE3L-OX40L virus as compared to tumor cells contacted with the corresponding MVAΔE3L virus. In some embodiments, of the virus of the present technology, the tumor cells comprise melanoma cells. In some embodiments, the mutant E3 gene is at least partially deleted, is not expressed, is expressed at levels so low as to have no effect, or expressed as a non-functional protein. In some embodiments, the mutant TK gene is at least partially deleted, is not expressed, is expressed at levels so low as to have no effect, or expressed as a non-functional protein.

In another aspect, the present disclosure provides an immunogenic composition comprising the recombinant MVAΔE3L-OX40L virus of the present technology. In some embodiments, the immunogenic composition of the present technology comprises a pharmaceutically acceptable carrier. In some embodiments, the immunogenic composition of the present technology comprises a pharmaceutically acceptable adjuvant.

In another aspect, the present disclosure provided a method for treating a solid tumor in a subject in need thereof, the method comprising delivering to a tumor a composition comprising an effective amount of the recombinant MVAΔE3L-OX40L virus of the present technology or an immunogenic composition of the present technology. In some embodiments of the method for treating a solid tumor in a subject in need thereof, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments of the method for treating a solid tumor in a subject in need thereof, the induction, enhancement, or promotion of the immune response comprises one or more of the following: increased levels of effector T-cells in tumor cells as compared to tumor cells infected with the corresponding MVAΔE3L virus; and increased splenic production of effector T-cells as compared to the corresponding MVAΔE3L virus. In some embodiments of the method for treating a solid tumor in a subject in need thereof, the composition is administered by intratumoral or intravenous injection or a simultaneous or sequential combination of intratumoral and intravenous injection. In some embodiments of the method for treating a solid tumor in a subject in need thereof, the tumor is melanoma, colon, breast, bladder, or prostate carcinoma. In some embodiments of the method for treating a solid tumor in a subject in need thereof, the composition further comprises one or more immune checkpoint blocking agents. In some embodiments of the method for treating a solid tumor in a subject in need thereof, the one or more immune checkpoint blocking agent is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments of the method for treating a solid tumor in a subject in need thereof, the one or more immune checkpoint blocking agents comprises anti-PD-1 antibody. In some embodiments of the method for treating a solid tumor in a subject in need thereof, the one or more immune checkpoint blocking agents comprises anti-PD-L1 antibody. In some embodiments of the method for treating a solid tumor in a subject in need thereof, the one or more immune checkpoint blocking agents comprises anti-CTLA-4 antibody. In some embodiments of the method for treating a solid tumor in a subject in need thereof, the combination of the MVAΔE3L-OX40L and the immune checkpoint blocking agent has a synergistic effect in the treatment of the tumor as compared to administration of either MVAΔE3L-OX40L or the immune checkpoint blocking agent alone.

In another aspect, the present disclosure provides a method of stimulating an immune response comprising administering to a subject an effective amount of a virus of the present technology (e.g., MVAΔE3L-OX40L) or an immunogenic composition of the present technology. In some embodiments, the method further comprises administering one or more immune checkpoint blocking agents to the subject. In some embodiments, the one or more immune checkpoint blocking agents is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments, the one or more immune checkpoint blocking agents comprises anti-PD-1 antibody. In some embodiments, the one or more immune checkpoint blocking agents comprises anti-PD-L1 antibody. In some embodiments, the one or more immune checkpoint blocking agents comprises anti-CTLA-4 antibody. In some embodiments, the combination of MVAΔE3L-OX40L and the immune checkpoint blocking agent has a synergistic effect in the treatment of the tumor as compared to administration of either MVAΔE3L-OX40L or the immune checkpoint blocking agent alone.

In another aspect, the present disclosure provides a recombinant vaccinia virus (VACV) comprising a mutant C7 gene and a heterologous nucleic acid molecule encoding OX40L (VACVΔC7L-OX40L). In some embodiments, the virus comprises a heterologous nucleic acid encoding human Fms-like tyrosine kinase 3 ligand (hFlt3L) (VACVΔC7L-hFlt3L-OX40L). In some embodiments, the virus comprises a mutant thymidine kinase (TK) gene. In some embodiments, the mutant TK gene comprises replacement of at least a portion of the gene with one or more gene cassettes comprising a heterologous nucleic acid molecule. In some embodiments, the one or more gene cassettes comprise the heterologous nucleic acid molecule encoding OX40L. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid molecule. In some embodiments, the one or more gene cassettes comprise a heterologous nucleic acid molecule encoding hFlt3L. In some embodiments, the mutant C7 gene comprises replacement of at least a portion of the gene with one or more gene cassettes comprising the heterologous nucleic acid molecule encoding hFlt3L, and wherein the virus further comprises a mutant TK gene comprising replacement of at least a portion of the TK gene with one or more gene cassettes comprising the heterologous nucleic acid molecule encoding OX40L (VACVΔC7L-hFlt3L-TK(−)-OX40L). In some embodiments, the OX40L is expressed from within a vaccinia viral gene. In some embodiments, the OX40L is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the OX40L is expressed from within the TK gene. In some embodiments, the OX40L is expressed from within the TK gene and the hFlt3L is expressed from within the C7 gene. In some embodiments, the virus further comprises a heterologous nucleic acid molecule encoding one or more of hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of E3L (ΔE3L), E3LΔ83N, B2R (ΔB2R), B19R (B18R; AWR200), E5R, K7R, C12L (IL18BP), B8R, B14R, N1L, C11R, K1L, M1L, N2L, or WR199. In some embodiments, the virus further comprises a heterologous nucleic acid encoding hIL-12 and a heterologous nucleic acid encoding anti-huCTLA-4 (VACVΔC7L-anti-huCTLA-4-hFlt3L-OX40L-hIL-12). In some embodiments, the recombinant VACVΔC7L-OX40L virus exhibits one or more of the following characteristics: induction of increased levels of effector T-cells in tumor cells as compared to tumor cells infected with the corresponding VACVΔC7L virus; induction of increased splenic production of effector T-cells as compared to the corresponding VACVΔC7L virus; and reduction of tumor volume in tumor cells contacted with the recombinant VACVΔC7L-OX40L virus as compared to tumor cells contacted with the corresponding VACVΔC7L virus. In some embodiments, the tumor cells comprise melanoma cells.

In another aspect, the present disclosure provides, an immunogenic composition comprising the recombinant VACVΔC7L-OX40L virus of the present technology. In some embodiments, the immunogenic composition comprises a pharmaceutically acceptable carrier. In some embodiments, the immunogenic composition comprises a pharmaceutically acceptable adjuvant.

In another aspect, the present disclosure provides a method for treating a solid tumor in a subject in need thereof, the method comprising delivering to a tumor a composition comprising an effective amount of the recombinant VACVΔC7L-OX40L virus of the present technology or the immunogenic composition of the present technology. In some embodiments of the method for treating a solid tumor in a subject in need thereof, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments of the method for treating a solid tumor in a subject in need thereof, the treatment comprises the induction, enhancement, or promotion of the immune response comprises one or more of the following: increased levels of effector T-cells in tumor cells as compared to tumor cells infected with the corresponding VACVΔC7Lvirus; and increased splenic production of effector T-cells as compared to the corresponding VACVΔC7L virus. In some embodiments of the method for treating a solid tumor in a subject in need thereof, the composition is administered by intratumoral or intravenous injection or a simultaneous or sequential combination of intratumoral and intravenous injection. In some embodiments of the method for treating a solid tumor in a subject in need thereof, the tumor is melanoma, colon, breast, bladder, or prostate carcinoma. In some embodiments of the method for treating a solid tumor in a subject in need thereof, the composition further comprises one or more immune checkpoint blocking agents. In some embodiments, the method further comprises administering to the subject one or more immune checkpoint blocking agents. In some embodiments the one or more immune checkpoint blocking agents is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments of the method for treating a solid tumor in a subject in need thereof, the one or more immune checkpoint blocking agents comprises the one or more immune checkpoint blocking agent comprises anti-PD-1 antibody. In some embodiments of the method for treating a solid tumor in a subject in need thereof, the one or more immune checkpoint blocking agents comprises the one or more immune checkpoint blocking agent comprises anti-PD-L1 antibody. In some embodiments of the method for treating a solid tumor in a subject in need thereof, comprises the one or more immune checkpoint blocking agent comprises anti-CTLA-4 antibody. In some embodiments of the method for treating a solid tumor in a subject in need thereof, the combination of the VACVΔC7L-OX40L or VACVΔC7L-hFlt3L-OX40L and the immune checkpoint blocking agent has a synergistic effect in the treatment of the tumor as compared to administration of VACVΔC7L-OX40L or VACVΔC7L-hFlt3L-OX40L or of the immune checkpoint blocking agent alone.

In another aspect, the present disclosure provides, a method for stimulating an immune response comprising administering to a subject an effective amount of the virus of the present technology (e.g., VACVΔC7L-OX40L or VACVΔC7L-hFlt3L-OX40L) or an immunogenic composition of the present technology. In some embodiments, the method further comprises administering one or more immune checkpoint blocking agents. In some embodiments, the one or more immune checkpoint blocking agents is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments, the immune checkpoint blocking agent comprises anti-PD-1 antibody. In some embodiments, the immune checkpoint blocking agent comprises anti-PD-L1 antibody. In some embodiments, the immune checkpoint blocking agent comprises anti-CTLA-4 antibody.

In another aspect, the present disclosure provides, a recombinant modified vaccinia Ankara (MVA) virus nucleic acid sequence, wherein the nucleic acid sequence between position 75,560 and 76,093 of SEQ ID NO: 1 is replaced with a heterologous nucleic acid sequence comprising an open reading frame that encodes OX40L, and wherein the MVA further comprises a C7 mutant. In some embodiments of the MVA virus of the present technology, the nucleic acid sequence between position 18,407 and 18,859 of SEQ ID NO: 1 is replaced with a heterologous nucleic acid sequence comprising an open reading frame that encodes human Fms-like tyrosine kinase 3 ligand (hFlt3L).

In another aspect, the present disclosure provides a recombinant modified vaccinia Ankara (MVA) virus nucleic acid sequence, wherein the nucleic acid sequence between position 75,798 to 75,868 of SEQ ID NO: 1 is replaced with a heterologous nucleic acid sequence comprising an open reading frame that encodes OX40L or encodes human Fms-like tyrosine kinase 3 ligand (hFlt3L), and wherein the MVA further comprises an E3 mutant.

In another aspect, the present disclosure provides a recombinant vaccinia virus (VACV) nucleic acid sequence, wherein the nucleic acid sequence between position 80,962 and 81,032 of SEQ ID NO: 2 is replaced with a heterologous nucleic acid sequence comprising an open reading frame that encodes OX40L or, and wherein the VACV further comprises a C7 mutant. In some embodiments the recombinant VACV of the present technology the nucleic acid sequence between position 15,716 and 16,168 of SEQ ID NO: 2 is replaced with a heterologous nucleic acid sequence comprising an open reading frame that encodes human Fms-like tyrosine kinase 3 ligand (hFlt3L).

In another aspect, the present disclosure provides a nucleic acid sequence encoding the recombinant MVAΔC7L-OX40L virus of the present technology.

In another aspect, the present disclosure provides a nucleic acid sequence encoding the recombinant MVAΔE3L-OX40L virus of the present technology.

In another aspect, the present disclosure provides a nucleic acid sequence encoding the recombinant VACVΔC7L-OX40L virus of any one of the present technology.

In another aspect, the present disclosure provides a kit comprising the recombinant MVAΔC7L-OX40L virus of the present technology or the immunogenic composition of the present technology, and instructions for use.

In another aspect, the present disclosure provides a kit comprising the recombinant MVAΔE3L-OX40L virus of any one of the present technology or the immunogenic composition of the present technology, and instructions for use.

In another aspect, the present disclosure provides a kit comprising the recombinant VACVΔC7L-OX40L virus of the present technology or the immunogenic composition of the present technology, and instructions for use.

In some embodiments, the present disclosure provides a recombinant MVAΔC7L-OX40L virus wherein the mutant C7 gene is at least partially deleted, is not expressed, is expressed at levels so low as to have no effect, or expressed as a non-functional protein. In some embodiments, the present disclosure provides a recombinant MVAΔC7L-OX40L virus, wherein the mutant TK gene is at least partially deleted, is not expressed, is expressed at levels so low as to have no effect, or expressed as a non-functional protein. In some embodiments, the present disclosure provides a recombinant MVAΔE3L-OX40L virus wherein the mutant E3 gene is at least partially deleted, is not expressed, is expressed at levels so low as to have no effect, or expressed as a non-functional protein. In some embodiments, the present disclosure provides a recombinant MVAΔE3L-OX40L virus wherein the mutant TK gene is at least partially deleted, is not expressed, is expressed at levels so low as to have no effect, or expressed as a non-functional protein. In some embodiments, the present technology provides a recombinant VACVΔC7L-OX40L virus wherein the mutant C7 gene is at least partially deleted, is not expressed, is expressed at levels so low as to have no effect, or expressed as a non-functional protein. In some embodiments, the present disclosure provides a recombinant VACVΔC7L-OX40L virus wherein the mutant TK gene is at least partially deleted, is not expressed, is expressed at levels so low as to have no effect, or expressed as a non-functional protein.

In another aspect, the present disclosure provides a method for treating a solid tumor in a subject in need thereof, the method comprising administering to the subject an antigen and a therapeutically effective amount of an adjuvant comprising a recombinant modified vaccinia Ankara (MVA) virus comprising a mutant C7 gene and a heterologous nucleic acid encoding OX40L (MVAΔC7L-OX40L). In some embodiments, the MVAΔC7L-OX40L virus further comprises a heterologous nucleic acid encoding human Fms-like tyrosine kinase 3 ligand (hFlt3L) (MVAΔC7L-hFlt3L-OX40L). In some embodiments, the virus further comprises a mutant thymidine kinase (TK) gene. In some embodiments, the mutant TK gene comprises replacement of at least a portion of the gene with one or more gene cassettes comprising a heterologous nucleic acid molecule. In some embodiments, the one or more gene cassettes comprise the heterologous nucleic acid molecule encoding OX40L. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid. In some embodiments, the one or more gene cassettes comprise a heterologous nucleic acid molecule encoding hFlt3L. In some embodiments, the mutant C7 gene comprises replacement of at least a portion of the gene with one or more gene cassettes comprising the heterologous nucleic acid molecule encoding hFlt3L, and wherein the virus further comprises a mutant TK gene comprising replacement of at least a portion of the TK gene with one or more gene cassettes comprising the heterologous nucleic acid molecule encoding OX40L (MVAΔC7L-hFlt3L-TK(−)-OX40L). In some embodiments, the OX40L is expressed from within a MVA viral gene. In some embodiments, the OX40L is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the OX40L is expressed from within the TK gene. In some embodiments, the OX40L is expressed from within the TK gene and the hFlt3L is expressed from within the C7 gene. In some embodiments, the virus further comprises a heterologous nucleic acid molecule encoding one or more of hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of E3L (ΔE3L), E3LΔ83N, B2R (ΔB2R), B19R (B18R; ΔWR200), IL18BP, E5R, K7R, C12L, B8R, B14R, N1L, C11R, K1L, M1L, N2L, or WR199.

In some embodiments, the antigen is selected from the group consisting of tumor differentiation antigens, cancer testis antigens, neoantigens, viral antigens in the case of tumors associated with oncogenic virus infection, GPA33, HER2/neu, GD2, MAGE-1, MAGE-3, BAGE, GAGE-1, GAGE-2, MUM-1, CDK4, N-acetylglucosaminyltransferase, p15, gp75, beta-catenin, ErbB2, cancer antigen 125 (CA-125), carcinoembryonic antigen (CEA), RAGE, MART (melanoma antigen), MUC-1, MUC-2, MUC-3, MUC-4, MUC-5ac, MUC-16, MUC-17, tyrosinase, tyrosinase-related proteins 1 and 2, Pmel 17 (gp100), GnT-V intron V sequence (N-acetylglucoaminyltransferase V intron V sequence), Prostate cancer psm, PRAME (melanoma antigen), β-catenin, EBNA (Epstein-Barr Virus nuclear antigen) 1-6, p53, kras, lung resistance protein (LRP) Bcl-2, prostate specific antigen (PSA), Ki-67, CEACAM6, colon-specific antigen-p (CSAp), NY-ESO-1, human papilloma virus E6 and E7, and any combination thereof.

In some embodiments, the administration step comprises administering the antigen and adjuvant in one or more doses and/or wherein the antigen and adjuvant are administered separately, sequentially, or simultaneously.

In some embodiments, the method further comprises administering to the subject an immune checkpoint blockade agent selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof.

In some embodiments, the antigen and adjuvant are delivered to the subject separately, sequentially, or simultaneously with the administration of the immune checkpoint blockade agent.

In some embodiments, the treatment comprises one or more of the following: inducing an immune response in the subject against the tumor or enhancing or promoting an ongoing immune response against the tumor in the subject, reducing the size of the tumor, eradicating the tumor, inhibiting growth of the tumor, inhibiting metastatic growth of the tumor, inducing apoptosis of the tumor cells, or prolonging survival of the subject. In some embodiments, the induction, enhancement, or promotion of the immune response comprises one or more of the following: (i) increased levels of interferon gamma (IFN-γ) expression in T-cells in the spleen, draining lymph nodes, and/or serum as compared to an untreated control sample; (ii) increased levels of antigen-specific T-cells in the spleen, draining lymph nodes, and/or serum as compared to an untreated control sample; and (iii) increased levels of antigen-specific immunoglobulin in serum as compared to an untreated control sample. In some embodiments, the antigen-specific immunoglobulin is IgG1 or IgG2.

In some embodiments, the antigen and adjuvant are formulated to be administered intratumorally, intramuscularly, intradermally, or subcutaneously.

In some embodiments, the tumor is selected from the group consisting of melanoma, colorectal cancer, breast cancer, bladder cancer, prostate cancer, lung cancer, pancreatic cancer, ovarian cancer, squamous cell carcinoma of the skin, Merkel cell carcinoma, gastric cancer, liver cancer, and sarcoma.

In some embodiments, the MVAΔC7L-OX40L virus is administered at a dosage per administration of about $10^5$ to about $10^{10}$ plaque-forming units (pfu).

In some embodiments of the method, the subject is human.

In one aspect, the present disclosure provides an immunogenic composition comprising the antigen and the adjuvant of the present technology. In some embodiments, the immunogenic composition further comprises a pharmaceutically acceptable carrier. In some embodiments, the antigen is selected from the group consisting of tumor differentiation antigens, cancer testis antigens, neoantigens, viral antigens in the case of tumors associated with oncogenic virus infection, GPA33, HER2/neu, GD2, MAGE-1, MAGE-3, BAGE, GAGE-1, GAGE-2, MUM-1, CDK4, N-acetylglucosaminyltransferase, p15, gp75, beta-catenin, ErbB2, cancer antigen 125 (CA-125), carcinoembryonic antigen (CEA), RAGE, MART (melanoma antigen), MUC-1, MUC-2, MUC-3, MUC-4, MUC-5ac, MUC-16, MUC-17, tyrosinase, tyrosinase-related proteins 1 and 2, Pmel 17 (gp100), GnT-V intron V sequence (N-acetylglucoaminyltransferase V intron V sequence), Prostate cancer psm, PRAME (melanoma antigen), β-catenin, EBNA (Epstein-Barr Virus nuclear antigen) 1-6, p53, kras, lung resistance protein (LRP) Bcl-2, prostate specific antigen (PSA), Ki-67, CEACAM6, colon-specific antigen-p (CSAp), NY-ESO-1, human papilloma virus E6 and E7, and any combination thereof. In some embodiments, the immunogenic composition further comprises an immune checkpoint blockade agent selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof.

In one aspect, the present disclosure provides a kit comprising instructions for use, a container means, and a separate portion of each of: (a) an antigen; and (b) an adjuvant of the present technology. In some embodiments of the kit, the antigen is selected from the group consisting of tumor differentiation antigens, cancer testis antigens, neoantigens, viral antigens in the case of tumors associated with oncogenic virus infection, GPA33, HER2/neu, GD2, MAGE-1, MAGE-3, BAGE, GAGE-1, GAGE-2, MUM-1, CDK4, N-acetylglucosaminyltransferase, p15, gp75, beta-catenin, ErbB2, cancer antigen 125 (CA-125), carcinoembryonic antigen (CEA), RAGE, MART (melanoma antigen), MUC-1, MUC-2, MUC-3, MUC-4, MUC-5ac, MUC-16, MUC-17, tyrosinase, tyrosinase-related proteins 1 and 2, Pmel 17

(gp100), GnT-V intron V sequence (N-acetylglucoaminyltransferase V intron V sequence), Prostate cancer psm, PRAME (melanoma antigen), β-catenin, EBNA (Epstein-Barr Virus nuclear antigen) 1-6, p53, kras, lung resistance protein (LRP) Bcl-2, prostate specific antigen (PSA), Ki-67, CEACAM6, colon-specific antigen-p (CSAp), NY-ESO-1, human papilloma virus E6 and E7, and any combination thereof.

In some embodiments, the kit further comprises (c) an immune checkpoint blockade agent selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof.

In some embodiments of the methods of the present technology, the antigen is a neoantigen selected from the group consisting of M27 (REGVELCPGNKYEMRRHGTTHSL VIHD) (SEQ ID NO: 17), M30 (PSKPSFQEFVDWENVSPELNSTDQPFL) (SEQ ID NO: 18), M48 (SHCHWNDLAVIPAGVVHNWDFEPRKVS) (SEQ ID NO: 19), and combinations thereof.

In some embodiments of the immunogenic compositions of the present technology, the antigen is a neoantigen selected from the group consisting of M27 (REGVELCPGNKYEMRRHGTTHSL VIHD) (SEQ ID NO: 17), M30 (PSKPSFQEFVDWENVSPELNSTDQPFL) (SEQ ID NO: 18), M48 (SHCHWNDLAVIPAGVVHNWDFEPRKVS) (SEQ ID NO: 19), and combinations thereof.

In some embodiments of the kit of the present technology, the antigen is a neoantigen selected from the group consisting of M27 (REGVELCPGNKYEMRRHGTTHSLVIHD) (SEQ ID NO: 17), M30 (PSKPSFQEFVDWENVSPELNSTDQPFL) (SEQ ID NO: 18), M48 (SHCHWNDLAVIPAGVVHNWDFEPRKVS) (SEQ ID NO: 19), and combinations thereof.

In one aspect, the present disclosure provides a modified vaccinia Ankara (MVA) virus genetically engineered to comprise a mutant E5R gene (MVAΔE5R). In some embodiments, the virus further comprises a heterologous nucleic acid molecule encoding one or more of OX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of thymidine kinase (TK), C7 (ΔC7L), E3L (ΔE3L), E3LΔ83N, B2R (ΔB2R), B19R (B18R; ΔWR200), IL18BP, K7R, C12L, B8R, B14R, N1L, C11R, K1L, M1L, N2L, or WR199. In some embodiments, the mutant E5R gene comprises replacement of at least a portion of the gene with one or more gene cassettes comprising the heterologous nucleic acid molecule. In some embodiments, the one or more gene cassettes comprises a heterologous nucleic acid molecule encoding OX40L (MVAΔE5R-OX40L). In some embodiments, the one or more gene cassettes further comprises a heterologous nucleic acid molecule encoding human Fms-like tyrosine kinase 3 ligand (hFlt3L) (MVAΔE5R-OX40L-hFlt3L). In some embodiments, the one or more gene cassettes comprises a heterologous nucleic acid molecule encoding human Fms-like tyrosine kinase 3 ligand (hFlt3L) (MVAΔE5R-hFlt3L). In some embodiments, the heterologous nucleic acid is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the virus further comprises a mutant thymidine kinase (TK) gene. In some embodiments, the mutant TK gene comprises replacement of at least a portion of the gene with one or more gene cassettes comprising a heterologous nucleic acid molecule. In some embodiments, the virus further comprises a mutant C7 gene. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid molecule.

In one aspect, the present disclosure provides an immunogenic composition comprising the MVAΔE5R virus. In some embodiments, the immunogenic composition further comprises a pharmaceutically acceptable carrier. In some embodiments, the immunogenic composition further comprises a pharmaceutically acceptable adjuvant.

In one aspect, the present disclosure provides a method for treating a solid tumor in a subject in need thereof, the method comprising delivering to a tumor a composition comprising an effective amount of the MVAΔE5R virus or the immunogenic composition. In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments, the composition is administered by intratumoral or intravenous injection or a simultaneous or sequential combination of intratumoral and intravenous injection. In some embodiments, the tumor is melanoma, colon, breast, bladder, or prostate carcinoma. In some embodiments, the composition further comprises one or more agents selected from: one or more immune checkpoint blocking agents; one or more anti-cancer drugs; fingolimod (FTY720); and any combination thereof.

In some embodiments, the method further comprises separately, sequentially, or simultaneously administering to the subject one or more agents selected from: one or more immune checkpoint blocking agents; one or more anti-cancer drugs, fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the MVAΔE5R virus with the immune checkpoint blocking agent, anti-cancer drug, and/or fingolimod (FTY720) has a synergistic effect in the treatment of the tumor as compared to administration of either the MVAΔE5R virus or of the immune checkpoint blocking agent, anti-cancer drug, or fingolimod (FTY720) alone.

In one aspect, the present disclosure provides a method of stimulating an immune response comprising administering to a subject an effective amount of the virus or the immunogenic composition. In som e embodiments, the method further comprises separately, sequentially, or simultaneously administering to the subject one or more agents selected from: one or more immune checkpoint blocking agents; one or more anti-cancer drugs; fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the MVAΔE5R virus with the immune checkpoint blocking agent, anti-cancer drug, and/or fingolimod (FTY720) has a synergistic effect in the stimulation of an immune response as compared to administration of the MVAΔE5R virus or of the immune checkpoint blocking agent, anti-cancer drug, or fingolimod (FTY720) alone.

In one aspect, the present disclosure provides a nucleic acid encoding the engineered MVAΔE5R viruses described herein.

In one aspect, the present disclosure provides a kit comprising the engineered MVAΔE5R viruses described herein, and instructions for use.

In one aspect, the present disclosure provides a vaccinia virus (VACV) genetically engineered to comprise a mutant E5R gene (VACVΔE5R). In some embodiments, the virus further comprises a heterologous nucleic acid molecule encoding one or more of OX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of thymidine kinase (TK), C7 (ΔC7L), E3L (ΔE3L), E3LΔ83N, B2R (ΔB2R), B19R (B18R; ΔWR200), IL18BP, K7R, C12L, B8R, B14R, N1L, C11R, K1L, M1L, N2L, or WR199. In some embodiments, the mutant E5R gene comprises replacement of at least a portion of the gene with one or more gene cassettes comprising the heterologous nucleic acid molecule. In some embodiments, the one or more gene cassettes comprises a heterologous nucleic acid molecule encoding OX40L (VACVΔE5R-OX40L). In some embodiments, the one or more gene cassettes further comprises a heterologous nucleic acid molecule encoding human Fms-like tyrosine kinase 3 ligand (hFlt3L) (VACVΔE5R-OX40L-hFlt3L). In some embodiments, the one or more gene cassettes comprises a heterologous nucleic acid molecule encoding human Fms-like tyrosine kinase 3 ligand (hFlt3L) (VACVΔE5R-hFlt3L). In some embodiments, the heterologous nucleic acid is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the virus further comprises a mutant thymidine kinase (TK) gene. In some embodiments, the mutant TK gene comprises replacement of at least a portion of the gene with one or more gene cassettes comprising a heterologous nucleic acid molecule. In some embodiments, the virus further comprises a mutant C7 gene. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid molecule.

In one aspect, the present disclosure provides an immunogenic composition comprising the VACVΔE5R virus. In some embodiments, the immunogenic composition further comprises a pharmaceutically acceptable carrier. In some embodiments, the immunogenic composition further comprises a pharmaceutically acceptable adjuvant.

In one aspect, the present disclosure provides a method for treating a solid tumor in a subject in need thereof, the method comprising delivering to a tumor a composition comprising an effective amount of the VACVΔE5R virus or the immunogenic composition. In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments, the composition is administered by intratumoral or intravenous injection or a simultaneous or sequential combination of intratumoral and intravenous injection. In some embodiments, the tumor is melanoma, colon, breast, bladder, or prostate carcinoma. In some embodiments, the composition further comprises one or more agents selected from: one or more immune checkpoint blocking agents; one or more anti-cancer drugs; fingolimod (FTY720); and any combination thereof.

In some embodiments, the method further comprises separately, sequentially, or simultaneously administering to the subject one or more agents selected from: one or more immune checkpoint blocking agents; one or more anti-cancer drugs, fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the VACVΔE5R virus with the immune checkpoint blocking agent, anti-cancer drug, and/or fingolimod (FTY720) has a synergistic effect in the treatment of the tumor as compared to administration of the VACVΔE5R virus or of the immune checkpoint blocking agent, anti-cancer drug, or fingolimod (FTY720) alone.

In one aspect, the present disclosure provides a method of stimulating an immune response comprising administering to a subject an effective amount of the virus or the immunogenic composition of. In some embodiments, the method further comprises separately, sequentially, or simultaneously administering to the subject one or more agents selected from: one or more immune checkpoint blocking agents; one or more anti-cancer drugs; fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the VACVΔE5R virus with the immune checkpoint blocking agent, anti-cancer drug, and/or fingolimod (FTY720) has a synergistic effect in the stimulation of an immune response as compared to administration of the VACVΔE5R virus or of the immune checkpoint blocking agent, anti-cancer drug, or fingolimod (FTY720) alone.

In one aspect, the present disclosure provides a nucleic acid encoding the engineered VACVΔE5R viruses of the present technology.

In one aspect, the present disclosure provides a kit comprising the engineered VACVΔE5R viruses of the present technology, and instructions for use.

In one aspect, the present disclosure provides a myxoma virus (MYXV) genetically engineered to comprise a mutant M31R gene (MYXVΔM31R). In some embodiments, tthe virus further comprises a heterologous nucleic acid molecule encoding one or more of OX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of myxoma orthologs of vaccinia virus thymidine kinase (TK), C7 (ΔC7L), E3L (ΔE3L), E3LΔ83N, B2R (ΔB2R), B19R (B18R; AWR200), IL18BP, K7R, C12L, B8R, B14R, N1L, C11R, K1L, M1L, N2L, or WR199. In some embodiments, the mutant M31R gene comprises replacement of at least a portion of the gene with one or more gene cassettes comprising the heterologous nucleic acid molecule. In some embodiments, the one or more gene cassettes comprises a heterologous nucleic acid molecule encoding OX40L (MYXVΔM31R-OX40L). In some embodiments, the one or more gene cassettes further comprises a heterologous nucleic acid molecule encoding human Fms-like tyrosine kinase 3 ligand (hFlt3L) (MYXVΔM31R-OX40L-hFlt3L). In some embodiments, the one or more gene cassettes comprises a heterologous nucleic acid molecule encoding human Fms-like tyrosine kinase 3 ligand (hFlt3L) (MYXVΔM31R-hFlt3L). In some embodiments, the heterologous nucleic acid is expressed from within a myxoma ortholog of a vaccinia viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the virus further comprises a mutant myxoma ortholog of vaccinia virus thymidine kinase (TK) gene. In some embodiments, the mutant TK gene comprises replacement of at least a portion of the gene with one or more gene cassettes comprising a heterologous nucleic acid molecule. In some embodiments, the virus further comprises a mutant myxoma ortholog of vaccinia virus C7 gene. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid molecule.

In one aspect, the present disclosure provides an immunogenic composition comprising the MYXVΔM31R virus. In some embodiments, the immunogenic composition further comprises a pharmaceutically acceptable carrier. In some embodiments, the immunogenic composition further comprises a pharmaceutically acceptable adjuvant.

In one aspect, the present disclosure provides a method for treating a solid tumor in a subject in need thereof, the method comprising delivering to a tumor a composition comprising an effective amount of the MYXVΔM31R virus or the immunogenic composition. In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments, the composition is administered by intratumoral or intravenous injection or a simultaneous or sequential combination of intratumoral and intravenous injection. In some embodiments, the tumor is melanoma, colon, breast, bladder, or prostate carcinoma.

In some embodiments, the composition further comprises one or more agents selected from: one or more immune checkpoint blocking agents; one or more anti-cancer drugs; fingolimod (FTY720); and any combination thereof. In some embodiments, the method further comprises separately, sequentially, or simultaneously administering to the subject one or more agents selected from: one or more immune checkpoint blocking agents; one or more anti-cancer drugs, fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the MYXVΔM31R virus with the immune checkpoint blocking agent, anti-cancer drug, and/or fingolimod (FTY720) has a synergistic effect in the treatment of the tumor as compared to administration of either the MYXVΔM31R virus or of the immune checkpoint blocking agent, anti-cancer drug, or fingolimod (FTY720) alone.

In one aspect, the present disclosure provides a method of stimulating an immune response comprising administering to a subject an effective amount of the virus or the immunogenic composition of. In some embodiments, the method further comprises separately, sequentially, or simultaneously administering to the subject one or more agents selected from: one or more immune checkpoint blocking agents; one or more anti-cancer drugs; fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG,and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the MYXVΔM31R virus with the immune checkpoint blocking agent, anti-cancer drug, and/or fingolimod (FTY720) has a synergistic effect in the stimulation of an immune response as compared to administration of the MYXVΔM31R virus or of the immune checkpoint blocking agent, anti-cancer drug, or fingolimod (FTY720) alone.

In one aspect, the present disclosure provides a nucleic acid encoding the engineered MYXVΔM31R viruses of the present technology.

In one aspect, the present disclosure provides a kit comprising the engineered MYXVΔM31R viruses of the present technology, and instructions for use.

In one aspect, the present disclosure provides a recombinant modified vaccinia Ankara (MVA) virus comprising a mutant C7 gene and a heterologous nucleic acid molecule encoding OX40L (MVAΔC7L-OX40L). In some embodiments, the recombinant MVAΔC7L-OX40L virus further comprises a heterologous nucleic acid encoding human Fms-like tyrosine kinase 3 ligand (hFlt3L) (MVAΔC7L-hFlt3L-OX40L). In some embodiments, the recombinant MVAΔC7L-OX40L virus of the present technology further comprises a mutant thymidine kinase (TK) gene. In some embodiments, the recombinant MVAΔC7L-OX40L virus comprising the mutant TK gene comprises replacement of at least a portion of the gene with one or more gene cassettes comprising a heterologous nucleic acid molecule. In some embodiments, the one or more gene cassettes comprise the heterologous nucleic acid molecule encoding OX40L. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid molecule. In some embodiments, the one or more gene cassettes comprise a heterologous nucleic acid molecule encoding hFlt3L. In some embodiments, the mutant C7 gene comprises replacement of at least a portion of the gene with one or more gene cassettes comprising the heterologous nucleic acid molecule encoding hFlt3L, and wherein the virus further comprises a mutant TK gene comprising replacement of at least a portion of the TK gene with one or more gene cassettes comprising the heterologous nucleic acid molecule encoding OX40L (MVAΔC7L-hFlt3L-TK(−)-OX40L). In some embodiments, the OX40L is expressed from within a MVA viral gene. In some embodiments, the OX40L is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the OX40L is expressed from within the TK gene. In some embodiments, the OX40L is expressed from within the TK gene and the hFlt3L is expressed from within the C7 gene. In some embodiments, the virus further comprises a heterologous nucleic acid molecule encoding one or more of hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of E3L (ΔE3L), E3LΔ83N, B2R (ΔB2R), B19R (B18R; ΔWR200), IL18BP, E5R, K7R, C12L, B8R, B14R, N1L, C11R, K1L, M1L, N2L, or WR199. In some embodiments, the recombinant MVA virus exhibits one or more of the following characteristics: induction of increased levels of effector T-cells in tumor cells as compared to tumor cells infected with the corresponding MVAΔC7L virus; induction of increased splenic production of effector T-cells as compared to the corresponding MVAΔC7L virus; and reduction of tumor volume in tumor cells contacted with the recombinant MVAΔC7L-OX40L virus as compared to tumor cells contacted with the corresponding MVAΔC7L virus. In some embodiments, the tumor cells comprise melanoma cells.

In another aspect, the present disclosure provides, an immunogenic composition comprising the recombinant MVAΔC7L-OX40L virus of the present technology. In some embodiments, the immunogenic composition further comprises a pharmaceutically acceptable carrier. In some embodiments, the immunogenic composition of the present technology comprises a pharmaceutically acceptable adjuvant.

In another aspect, the present disclosure provides a method for treating a solid tumor in a subject in need thereof, the method comprising delivering to a tumor a composition comprising an effective amount of the recombinant MVAΔC7L-the present technology. In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments, the method for treating a solid tumor in a subject in need thereof comprises the induction, enhancement, or promotion of the immune response comprises one or more of the following: increased levels of effector T-cells in tumor cells as compared to tumor cells infected with the corresponding MVAΔC7L virus; and increased splenic production of effector T-cells as compared to the corresponding MVAΔC7L virus. In some embodiments, the method of treating a solid tumor in a subject in need thereof the composition is administered by intratumoral or intravenous injection or a simultaneous or sequential combination of intratumoral and intravenous injection. In some embodiments of the method of treating a solid tumor in a subject in need thereof, the tumor is melanoma, colon, breast, bladder, or prostate carcinoma. In some embodiments of the method of treating a solid tumor in a subject in need thereof, the composition comprises one or more immune checkpoint blocking agents. In some embodiments of the method of treating a solid tumor in a subject in need thereof, the method further comprises administering to the subject one or more immune checkpoint blocking agents. In some embodiments of the method of treating a solid tumor in a subject in need thereof, the one or more immune checkpoint blocking agent is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments of the method of treating a solid tumor in a subject in need thereof, the one or more immune checkpoint blocking agents comprises anti-PD-1 antibody. In some embodiments of the method of treating a solid tumor in a subject in need thereof, the one or more immune checkpoint blocking agents comprises anti-PD-L1 antibody. In some embodiments of the method of treating a solid tumor in a subject in need thereof, the one or more immune checkpoint blocking agents comprises anti-CTLA-4 antibody. In some embodiments of the method of treating a solid tumor in a subject in need thereof, the combination of the MVAΔC7L-OX40L or MVAΔC7L-hFlt3L-OX40L and the immune checkpoint blocking agent has a synergistic effect in the treatment of the tumor as compared to administration of either the MVAΔC7L-OX40L or MVAΔC7L-hFlt3L-OX40L or of the immune checkpoint blocking agent alone.

In another aspect, the present disclosure provides a method of stimulating an immune response comprising administering to a subject an effective amount of the virus of the present technology (e.g., MVAΔC7L-OX40L, MVAΔC7L-hFlt3L-OX40L) or an immunogenic composition of the present technology. In some embodiments, the method further comprises administering to the subject one or more immune checkpoint blocking agents. In some embodiments, the one or more immune checkpoint blocking agents is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments, the one or more immune checkpoint blocking agents comprises anti-PD-1 antibody. In some embodiments, the one or more immune checkpoint blocking agents comprises anti-PD-L1 antibody. In some embodiments, the one or more immune checkpoint blocking agents comprises anti-CTLA-4 antibody.

In another aspect, the present disclosure provides, a recombinant modified vaccinia Ankara (MVA) virus comprising a mutant E3 gene and a heterologous nucleic acid molecule encoding OX40L (MVAΔE3L-OX40L). In some embodiments, the recombinant MVAΔE3L-OX40L virus comprises a mutant thymidine kinase (TK) gene. In some embodiments, the mutant TK gene comprises replacement of at least a portion of the gene with one or more gene cassettes comprising a heterologous nucleic acid molecule. In some embodiments, the one or more gene cassettes comprise the heterologous nucleic acid molecule encoding OX40L. In some embodiments of the virus of the present technology, the OX40L is expressed from within a MVA viral gene. In some embodiments of the virus of the present technology, the OX40L is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, of the virus of the present technology, the OX40L is expressed from within the TK gene. In some embodiments, of the virus of the present technology, the virus comprises a heterologous nucleic acid molecule encoding one or more of hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of E3LΔ83N, B2R (ΔB2R), B19R (B18R; ΔWR200), E5R, K7R, C12L (IL18BP), B8R, B14R, N1L, C11R, K1L, M1L, N2L, or WR199. In some embodiments, of the virus of the present technology, the recombinant MVA virus exhibits one or more of the following characteristics: induction of increased levels of effector T-cells in tumor cells as compared to tumor cells infected with the corresponding MVAΔE3L virus; induction of increased splenic production of effector T-cells as compared to the corresponding MVAΔE3L virus; and reduction of tumor volume in tumor cells contacted with the recombinant MVAΔE3L-OX40L virus as compared to tumor cells contacted with the corresponding MVAΔE3L virus. In some embodiments, of the virus of the present technology, the tumor cells comprise melanoma cells. In some embodiments, the mutant E3 gene is at least partially deleted, is not expressed, is expressed at levels so low as to have no effect, or expressed as a non-functional protein. In some embodiments, the mutant TK gene is at least partially deleted, is not expressed, is expressed at levels so low as to have no effect, or expressed as a non-functional protein.

In another aspect, the present disclosure provides an immunogenic composition comprising the recombinant MVAΔE3L-OX40L virus of the present technology. In some embodiments, the immunogenic composition of the present technology comprises a pharmaceutically acceptable carrier. In some embodiments, the immunogenic composition of the present technology comprises a pharmaceutically acceptable adjuvant.

In another aspect, the present disclosure provided a method for treating a solid tumor in a subject in need thereof, the method comprising delivering to a tumor a composition comprising an effective amount of the recombinant MVAΔE3L-OX40L virus of the present technology or an immunogenic composition of the present technology. In some embodiments of the method for treating a solid tumor in a subject in need thereof, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments of the method for treating a solid tumor in a subject in need thereof, the induction, enhancement, or promotion of the immune response comprises one or more of the following: increased levels of effector T-cells in tumor cells as compared to tumor cells infected with the corresponding MVAΔE3L virus; and increased splenic production of effector T-cells as compared to the corresponding MVAΔE3L virus. In some embodiments of the method for treating a solid tumor in a subject in need thereof, the composition is administered by intratumoral or intravenous injection or a simultaneous or sequential combination of intratumoral and intravenous injection. In some embodiments of the method for treating a solid tumor in a subject in need thereof, the tumor is melanoma, colon, breast, bladder, or prostate carcinoma. In some embodiments of the method for treating a solid tumor in a subject in need thereof, the composition further comprises one or more immune checkpoint blocking agents. In some embodiments of the method for treating a solid tumor in a subject in need thereof, the one or more immune checkpoint blocking agent is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments of the method for treating a solid tumor in a subject in need thereof, the one or more immune checkpoint blocking agents comprises anti-PD-1 antibody. In some embodiments of the method for treating a solid tumor in a subject in need thereof, the one or more immune checkpoint blocking agents comprises anti-PD-L1 antibody. In some embodiments of the method for treating a solid tumor in a subject in need thereof, the one or more immune checkpoint blocking agents comprises anti-CTLA-4 antibody. In some embodiments of the method for treating a solid tumor in a subject in need thereof, the combination of the MVAΔE3L-OX40L and the immune checkpoint blocking agent has a synergistic effect in the treatment of the tumor as compared to administration of either MVAΔE3L-OX40L or the immune checkpoint blocking agent alone.

In another aspect, the present disclosure provides a method of stimulating an immune response comprising administering to a subject an effective amount of a virus of the present technology (e.g., MVAΔE3L-OX40L) or an immunogenic composition of the present technology. In some embodiments, the method further comprises administering one or more immune checkpoint blocking agents to the subject. In some embodiments, the one or more immune checkpoint blocking agents is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments, the one or more immune checkpoint blocking agents comprises anti-PD-1 antibody. In some embodiments, the one or more immune checkpoint blocking agents comprises anti-PD-L1 antibody. In some embodiments, the one or more immune checkpoint blocking agents comprises anti-CTLA-4 antibody. In some embodiments, the combination of MVAΔE3L-OX40L and the immune checkpoint blocking agent has a synergistic effect in the treatment of the tumor as compared to administration of either MVAΔE3L-OX40L or the immune checkpoint blocking agent alone.

In another aspect, the present disclosure provides a recombinant vaccinia virus (VACV) comprising a mutant C7 gene and a heterologous nucleic acid molecule encoding OX40L (VACVΔC7L-OX40L). In some embodiments, the virus comprises a heterologous nucleic acid encoding human Fms-like tyrosine kinase 3 ligand (hFlt3L) (VACVΔC7L-hFlt3L-OX40L). In some embodiments, the virus comprises a mutant thymidine kinase (TK) gene. In some embodiments, the mutant TK gene comprises replacement of at least a portion of the gene with one or more gene cassettes comprising a heterologous nucleic acid molecule. In some embodiments, the one or more gene cassettes comprise the heterologous nucleic acid molecule encoding OX40L. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid molecule. In some embodiments, the one or more gene cassettes comprise a heterologous nucleic acid molecule encoding hFlt3L. In some embodiments, the mutant C7 gene comprises replacement of at least a portion of the gene with one or more gene cassettes comprising the heterologous nucleic acid molecule encoding hFlt3L, and wherein the virus further comprises a mutant TK gene comprising replacement of at least a portion of the TK gene with one or more gene cassettes comprising the heterologous nucleic acid molecule encoding OX40L (VACVΔC7L-hFlt3L-TK(−)-OX40L). In some embodiments, the OX40L is expressed from within a vaccinia viral gene. In some embodiments, the OX40L is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the OX40L is expressed from within the TK gene. In some embodiments, the OX40L is expressed from within the TK gene and the hFlt3L is expressed from within the C7 gene. In some embodiments, the virus further comprises a heterologous nucleic acid molecule encoding one or more of hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of E3L (ΔE3L), E3LΔ83N, B2R (ΔB2R), B19R (B18R; ΔWR200), E5R, K7R, C12L (IL18BP), B8R, B14R, N1L, C11R, K1L, M1L, N2L, or WR199. In some embodiments, the virus further comprises a heterologous nucleic acid encoding hIL-12 and a heterologous nucleic acid encoding anti-huCTLA-4 (VACVΔC7L-anti-huCTLA-4-hFlt3L-OX40L-hIL-12). In some embodiments, the recombinant VACVΔC7L-OX40L virus exhibits one or more of the following characteristics: induction of increased levels of effector T-cells in tumor cells as compared to tumor cells infected with the corresponding VACVΔC7L virus; induction of increased splenic production of effector T-cells as compared to the corresponding VACVΔC7L virus; and reduction of tumor volume in tumor cells contacted with the recombinant VACVΔC7L-OX40L virus as compared to tumor cells contacted with the corresponding VACVΔC7L virus. In some embodiments, the tumor cells comprise melanoma cells.

In another aspect, the present disclosure provides, an immunogenic composition comprising the recombinant VACVΔC7L-OX40L virus of the present technology. In some embodiments, the immunogenic composition comprises a pharmaceutically acceptable carrier. In some embodiments, the immunogenic composition comprises a pharmaceutically acceptable adjuvant.

In another aspect, the present disclosure provides a method for treating a solid tumor in a subject in need thereof, the method comprising delivering to a tumor a composition comprising an effective amount of the recombinant VACVΔC7L-OX40L virus of the present technology or the immunogenic composition of the present technology. In some embodiments of the method for treating a solid tumor in a subject in need thereof, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments of the method for treating a solid tumor in a subject in need thereof, the treatment comprises the induction, enhancement, or promotion of the immune response comprises one or more of the following: increased levels of effector T-cells in tumor cells as compared to tumor cells infected with the corresponding VACVΔC7Lvirus; and increased splenic production of effector T-cells as compared to the corresponding VACVΔC7L virus. In some embodiments of the method for treating a solid tumor in a subject in need thereof, the composition is administered by intratumoral or intravenous injection or a simultaneous or sequential combination of intratumoral and intravenous injection. In some embodiments of the method for treating a solid tumor in a subject in need thereof, the tumor is melanoma, colon, breast, bladder, or prostate carcinoma. In some embodiments of the method for treating a solid tumor in a subject in need thereof, the composition further comprises one or more immune checkpoint blocking agents. In some embodiments, the method further comprises administering to the subject one or more immune checkpoint blocking agents. In some embodiments the one or more immune checkpoint blocking agents is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments of the method for treating a solid tumor in a subject in need thereof, the one or more immune checkpoint blocking agents comprises the one or more immune checkpoint blocking agent comprises anti-PD-1 antibody. In some embodiments of the method for treating a solid tumor in a subject in need thereof, the one or more immune checkpoint blocking agents comprises the one or more immune checkpoint blocking agent comprises anti-PD-L1 antibody. In some embodiments of the method for treating a solid tumor in a subject in need thereof, comprises the one or more immune checkpoint blocking agent comprises anti-CTLA-4 antibody. In some embodiments of the method for treating a solid tumor in a subject in need thereof, the combination of the VACVΔC7L-OX40L or VACVΔC7L-hFlt3L-OX40L and the immune checkpoint blocking agent has a synergistic effect in the treatment of the tumor as compared to administration of VACVΔC7L-OX40L or VACVΔC7L-hFlt3L-OX40L or of the immune checkpoint blocking agent alone.

In another aspect, the present disclosure provides, a method for stimulating an immune response comprising administering to a subject an effective amount of the virus of the present technology (e.g., VACVΔC7L-OX40L or VACVΔC7L-hFlt3L-OX40L) or an immunogenic composition of the present technology. In some embodiments, the method further comprises administering one or more immune checkpoint blocking agents. In some embodiments, the one or more immune checkpoint blocking agents is selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments, the immune checkpoint blocking agent comprises anti-PD-1 antibody. In some embodiments, the immune checkpoint blocking agent comprises anti-PD-L1 antibody. In some embodiments, the immune checkpoint blocking agent comprises anti-CTLA-4 antibody.

In another aspect, the present disclosure provides, a recombinant modified vaccinia Ankara (MVA) virus nucleic acid sequence, wherein the nucleic acid sequence between position 75,560 and 76,093 of SEQ ID NO: 1 is replaced with a heterologous nucleic acid sequence comprising an open reading frame that encodes OX40L, and wherein the MVA further comprises a C7 mutant. In some embodiments of the MVA virus of the present technology, the nucleic acid sequence between position 18,407 and 18,859 of SEQ ID NO: 1 is replaced with a heterologous nucleic acid sequence comprising an open reading frame that encodes human Fms-like tyrosine kinase 3 ligand (hFlt3L).

In another aspect, the present disclosure provides a recombinant modified vaccinia Ankara (MVA) virus nucleic acid sequence, wherein the nucleic acid sequence between position 75,798 to 75,868 of SEQ ID NO: 1 is replaced with a heterologous nucleic acid sequence comprising an open reading frame that encodes OX40L or encodes human Fms-like tyrosine kinase 3 ligand (hFlt3L), and wherein the MVA further comprises an E3 mutant.

In another aspect, the present disclosure provides a recombinant vaccinia virus (VACV) nucleic acid sequence, wherein the nucleic acid sequence between position 80,962 and 81,032 of SEQ ID NO: 2 is replaced with a heterologous nucleic acid sequence comprising an open reading frame that encodes OX40L or, and wherein the VACV further comprises a C7 mutant. In some embodiments the recombinant VACV of the present technology the nucleic acid sequence between position 15,716 and 16,168 of SEQ ID NO: 2 is replaced with a heterologous nucleic acid sequence comprising an open reading frame that encodes human Fms-like tyrosine kinase 3 ligand (hFlt3L).

In another aspect, the present disclosure provides a nucleic acid sequence encoding the recombinant MVAΔC7L-OX40L virus of the present technology.

In another aspect, the present disclosure provides a nucleic acid sequence encoding the recombinant MVAΔE3L-OX40L virus of the present technology.

In another aspect, the present disclosure provides a nucleic acid sequence encoding the recombinant VACVΔC7L-OX40L virus of any one of the present technology.

In another aspect, the present disclosure provides a kit comprising the recombinant MVAΔC7L-OX40L virus of the present technology or the immunogenic composition of the present technology, and instructions for use.

In another aspect, the present disclosure provides a kit comprising the recombinant MVAΔE3L-OX40L virus of any one of the present technology or the immunogenic composition of the present technology, and instructions for use.

In another aspect, the present disclosure provides a kit comprising the recombinant VACVΔC7L-OX40L virus of the present technology or the immunogenic composition of the present technology, and instructions for use.

In some embodiments, the present disclosure provides a recombinant MVAΔC7L-OX40L virus wherein the mutant C7 gene is at least partially deleted, is not expressed, is expressed at levels so low as to have no effect, or expressed as a non-functional protein. In some embodiments, the present disclosure provides a recombinant MVAΔC7L-OX40L virus, wherein the mutant TK gene is at least partially deleted, is not expressed, is expressed at levels so low as to have no effect, or expressed as a non-functional protein. In some embodiments, the present disclosure provides a recombinant MVAΔE3L-OX40L virus wherein the mutant E3 gene is at least partially deleted, is not expressed, is expressed at levels so low as to have no effect, or expressed as a non-functional protein. In some embodiments, the present disclosure provides a recombinant MVAΔE3L-OX40L virus wherein the mutant TK gene is at least partially deleted, is not expressed, is expressed at levels so low as to have no effect, or expressed as a non-functional protein. In some embodiments, the present technology provides a recombinant VACVΔC7L-OX40L virus wherein the mutant C7 gene is at least partially deleted, is not expressed, is expressed at levels so low as to have no effect, or expressed as a non-functional protein. In some embodiments, the present disclosure provides a recombinant VACVΔC7L-OX40L virus wherein the mutant TK gene is at least partially deleted, is not expressed, is expressed at levels so low as to have no effect, or expressed as a non-functional protein.

In another aspect, the present disclosure provides a method for treating a solid tumor in a subject in need thereof, the method comprising administering to the subject an antigen and a therapeutically effective amount of an adjuvant comprising a recombinant modified vaccinia Ankara (MVA) virus comprising a mutant C7 gene and a heterologous nucleic acid encoding OX40L (MVAΔC7L-OX40L). In some embodiments, the MVAΔC7L-OX40L virus further comprises a heterologous nucleic acid encoding human Fms-like tyrosine kinase 3 ligand (hFlt3L) (MVAΔC7L-hFlt3L-OX40L). In some embodiments, the virus further comprises a mutant thymidine kinase (TK) gene. In some embodiments, the mutant TK gene comprises replacement of at least a portion of the gene with one or more gene cassettes comprising a heterologous nucleic acid molecule. In some embodiments, the one or more gene cassettes comprise the heterologous nucleic acid molecule encoding OX40L. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid. In some embodiments, the one or more gene cassettes comprise a heterologous nucleic acid molecule encoding hFlt3L. In some embodiments, the mutant C7 gene comprises replacement of at least a portion of the gene with one or more gene cassettes comprising the heterologous nucleic acid molecule encoding hFlt3L, and wherein the virus further comprises a mutant TK gene comprising replacement of at least a portion of the TK gene with one or more gene cassettes comprising the heterologous nucleic acid molecule encoding OX40L (MVAΔC7L-hFlt3L-TK(−)-OX40L). In some embodiments, the OX40L is expressed from within a MVA viral gene. In some embodiments, the OX40L is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the OX40L is expressed from within the TK gene. In some embodiments, the OX40L is expressed from within the TK gene and the hFlt3L is expressed from within the C7 gene. In some embodiments, the virus further comprises a heterologous nucleic acid molecule encoding one or more of hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of E3L (ΔE3L), E3LΔ83N, B2R (ΔB2R), B19R (B18R; ΔWR200), IL18BP, E5R, K7R, C12L, B8R, B14R, N1L, C11R, K1L, M1L, N2L, or WR199.

In some embodiments, the antigen is selected from the group consisting of tumor differentiation antigens, cancer testis antigens, neoantigens, viral antigens in the case of tumors associated with oncogenic virus infection, GPA33, HER2/neu, GD2, MAGE-1, MAGE-3, BAGE, GAGE-1, GAGE-2, MUM-1, CDK4, N-acetylglucosaminyltransferase, p15, gp75, beta-catenin, ErbB2, cancer antigen 125 (CA-125), carcinoembryonic antigen (CEA), RAGE, MART (melanoma antigen), MUC-1, MUC-2, MUC-3, MUC-4, MUC-5ac, MUC-16, MUC-17, tyrosinase, tyrosinase-related proteins 1 and 2, Pmel 17 (gp100), GnT-V intron V sequence (N-acetylglucoaminyltransferase V intron V sequence), Prostate cancer psm, PRAME (melanoma antigen), β-catenin, EBNA (Epstein-Barr Virus nuclear antigen) 1-6, p53, kras, lung resistance protein (LRP) Bcl-2, prostate specific antigen (PSA), Ki-67, CEACAM6, colon-specific antigen-p (CSAp), NY-ESO-1, human papilloma virus E6 and E7, and any combination thereof.

In some embodiments, the administration step comprises administering the antigen and adjuvant in one or more doses and/or wherein the antigen and adjuvant are administered separately, sequentially, or simultaneously.

In some embodiments, the method further comprises administering to the subject an immune checkpoint blockade agent selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof.

In some embodiments, the antigen and adjuvant are delivered to the subject separately, sequentially, or simultaneously with the administration of the immune checkpoint blockade agent.

In some embodiments, the treatment comprises one or more of the following: inducing an immune response in the subject against the tumor or enhancing or promoting an ongoing immune response against the tumor in the subject, reducing the size of the tumor, eradicating the tumor, inhibiting growth of the tumor, inhibiting metastatic growth of the tumor, inducing apoptosis of the tumor cells, or prolonging survival of the subject. In some embodiments, the induction, enhancement, or promotion of the immune response comprises one or more of the following: (i) increased levels of interferon gamma (IFN-γ) expression in T-cells in the spleen, draining lymph nodes, and/or serum as compared to an untreated control sample; (ii) increased levels of antigen-specific T-cells in the spleen, draining lymph nodes, and/or serum as compared to an untreated control sample; and (iii) increased levels of antigen-specific immunoglobulin in serum as compared to an untreated control sample. In some embodiments, the antigen-specific immunoglobulin is IgG1 or IgG2.

In some embodiments, the antigen and adjuvant are formulated to be administered intratumorally, intramuscularly, intradermally, or subcutaneously.

In some embodiments, the tumor is selected from the group consisting of melanoma, colorectal cancer, breast cancer, bladder cancer, prostate cancer, lung cancer, pancreatic cancer, ovarian cancer, squamous cell carcinoma of the skin, Merkel cell carcinoma, gastric cancer, liver cancer, and sarcoma.

In some embodiments, the MVAΔC7L-OX40L virus is administered at a dosage per administration of about $10^5$ to about $10^{10}$ plaque-forming units (pfu).

In some embodiments of the method, the subject is human.

In one aspect, the present disclosure provides an immunogenic composition comprising the antigen and the adjuvant of the present technology. In some embodiments, the immunogenic composition further comprises a pharmaceutically acceptable carrier. In some embodiments, the antigen is selected from the group consisting of tumor differentiation antigens, cancer testis antigens, neoantigens, viral antigens in the case of tumors associated with oncogenic virus infection, GPA33, HER2/neu, GD2, MAGE-1, MAGE-3, BAGE, GAGE-1, GAGE-2, MUM-1, CDK4, N-acetylglucosaminyltransferase, p15, gp75, beta-catenin, ErbB2, cancer antigen 125 (CA-125), carcinoembryonic antigen (CEA), RAGE, MART (melanoma antigen), MUC-1, MUC-2, MUC-3, MUC-4, MUC-5ac, MUC-16, MUC-17, tyrosinase, tyrosinase-related proteins 1 and 2, Pmel 17 (gp100), GnT-V intron V sequence (N-acetylglucoaminyltransferase V intron V sequence), Prostate cancer psm, PRAME (melanoma antigen), β-catenin, EBNA (Epstein-Barr Virus nuclear antigen) 1-6, p53, kras, lung resistance protein (LRP) Bcl-2, prostate specific antigen (PSA), Ki-67, CEACAM6, colon-specific antigen-p (CSAp), NY-ESO-1, human papilloma virus E6 and E7, and any combination thereof. In some embodiments, the immunogenic composition further comprises an immune checkpoint blockade agent selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof.

In one aspect, the present disclosure provides a kit comprising instructions for use, a container means, and a separate portion of each of: (a) an antigen; and (b) an adjuvant of the present technology. In some embodiments of the kit, the antigen is selected from the group consisting of tumor differentiation antigens, cancer testis antigens, neoantigens, viral antigens in the case of tumors associated with oncogenic virus infection, GPA33, HER2/neu, GD2, MAGE-1, MAGE-3, BAGE, GAGE-1, GAGE-2, MUM-1, CDK4, N-acetylglucosaminyltransferase, p15, gp75, beta-catenin, ErbB2, cancer antigen 125 (CA-125), carcinoembryonic antigen (CEA), RAGE, MART (melanoma antigen), MUC-1, MUC-2, MUC-3, MUC-4, MUC-5ac, MUC-16, MUC-17, tyrosinase, tyrosinase-related proteins 1 and 2, Pmel 17 (gp100), GnT-V intron V sequence (N-acetylglucoaminyltransferase V intron V sequence), Prostate cancer psm, PRAME (melanoma antigen), β-catenin, EBNA (Epstein-Barr Virus nuclear antigen) 1-6, p53, kras, lung resistance protein (LRP) Bcl-2, prostate specific antigen (PSA), Ki-67, CEACAM6, colon-specific antigen-p (CSAp), NY-ESO-1, human papilloma virus E6 and E7, and any combination thereof.

In some embodiments, the kit further comprises (c) an immune checkpoint blockade agent selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof.

In some embodiments of the methods of the present technology, the antigen is a neoantigen selected from the group consisting of M27 (REGVELCPGNKYEMRRHGTTHSL VIHD) (SEQ ID NO: 17), M30 (PSKPSFQEFVDWENVSPELNSTDQPFL) (SEQ ID NO: 18), M48 (SHCHWNDLAVIPAGVVHNWDFEPRKVS) (SEQ ID NO: 19), and combinations thereof.

In some embodiments of the immunogenic compositions of the present technology, the antigen is a neoantigen selected from the group consisting of M27 (REGVELCPGNKYEMRRHGTTHSL VIHD) (SEQ ID NO: 17), M30 (PSKPSFQEFVDWENVSPELNSTDQPFL) (SEQ ID NO: 18), M48 (SHCHWNDLAVIPAGVVHNWDFEPRKVS) (SEQ ID NO: 19), and combinations thereof.

In some embodiments of the kit of the present technology, the antigen is a neoantigen selected from the group consisting of M27 (REGVELCPGNKYEMRRHGTTHSL VIHD) (SEQ ID NO: 17), M30 (PSKPSFQEFVDWENVSPELNSTDQPFL) (SEQ ID NO: 18), M48 (SHCHWNDLAVIPAGVVHNWDFEPRKVS) (SEQ ID NO: 19), and combinations thereof.

In one aspect, the present disclosure provides a modified vaccinia Ankara (MVA) virus genetically engineered to comprise a mutant E5R gene (MVAΔE5R). In some embodiments, the virus further comprises a heterologous nucleic acid molecule encoding one or more of OX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of thymidine kinase (TK), C7 (ΔC7L), E3L (ΔE3L), E3LΔ83N, B2R (ΔB2R), B19R (B18R; ΔWR200), IL18BP, K7R, C12L, B8R, B14R, N1L, C11R, K1L, M1L, N2L, or WR199. In some embodiments, the mutant E5R gene comprises replacement of at least a portion of the gene with one or more gene cassettes comprising the heterologous nucleic acid molecule. In some embodiments, the one or more gene cassettes comprises a heterologous nucleic acid molecule encoding OX40L (MVAΔE5R-OX40L). In some embodiments, the one or more gene cassettes further comprises a heterologous nucleic acid molecule encoding human Fms-like tyrosine kinase 3 ligand (hFlt3L) (MVAΔE5R-OX40L-hFlt3L). In some embodiments, the one or more gene cassettes comprises a heterologous nucleic acid molecule encoding human Fms-like tyrosine kinase 3 ligand (hFlt3L) (MVAΔE5R-hFlt3L). In some embodiments, the heterologous nucleic acid is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the virus further comprises a mutant thymidine kinase (TK) gene. In some embodiments, the mutant TK gene comprises replacement of at least a portion of the gene with one or more gene cassettes comprising a heterologous nucleic acid molecule. In some embodiments, the virus further comprises a mutant C7 gene. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid molecule. In some embodiments, the MVAΔE5R-OX40L-hFlt3L virus further comprises a mutant C11R gene (MVAΔE5R-OX40L-hFlt3L-ΔC11R). In some embodiments, the mutant C11R gene comprises an insertion of one or more gene cassettes comprising a heterologous nucleic acid molecule. In some embodiments, the mutant C11R gene comprises replacement of all or at least a portion of the gene with one or more gene cassettes comprising a heterologous nucleic acid molecule. In some embodiments, the MVAΔE5R-OX40L-hFlt3L virus further comprises a mutant WR199 gene (MVAΔE5R-OX40L-hFlt3L-ΔWR199). In some embodiments, the mutant WR199 gene comprises an insertion or one or more gene cassettes comprising a heterologous nucleic acid molecule. In some embodiments, the mutant WR199 gene comprises replacement of all or at least a portion of the gene with one or more gene cassettes comprising a heterologous nucleic acid molecule. In some embodiments, the MVAΔE5R virus further comprises a mutant E3L gene (ΔE3L). In some embodiments, the mutant E3L gene comprises an insertion of one or more gene cassettes comprising a heterologous nucleic acid molecule. In some embodiments, the mutant E3L gene comprises replacement of all or at least a portion of the gene with one or more gene cassettes comprising a heterologous nucleic acid molecule. In some embodiments, the one or more gene cassettes comprises a heterologous nucleic acid molecule encoding OX40L. In some embodiments, the one or more gene cassettes further comprises a heterologous nucleic acid molecule encoding human Fms-like tyrosine kinase 3 ligand (hFlt3L). In some embodiments, the one or more gene cassettes comprises a heterologous nucleic acid encoding human Fms-like typrsine kinase 3 ligand (hFlt3L).

In one aspect, the present disclosure provides an immunogenic composition comprising the MVAΔE5R virus. In some embodiments, the immunogenic composition further comprises a pharmaceutically acceptable carrier. In some embodiments, the immunogenic composition further comprises a pharmaceutically acceptable adjuvant.

In one aspect, the present disclosure provides a method for treating a solid tumor in a subject in need thereof, the method comprising delivering to a tumor a composition comprising an effective amount of the MVAΔE5R virus or the immunogenic composition. In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments, the composition is administered by intratumoral or intravenous injection or a simultaneous or sequential combination of intratumoral and intravenous injection. In some embodiments, the tumor is melanoma, colon, breast, bladder, or prostate carcinoma. In some embodiments, the composition further comprises one or more agents selected from: one or more immune checkpoint blocking agents; one or more anti-cancer drugs; fingolimod (FTY720); and any combination thereof.

In some embodiments, the method further comprises separately, sequentially, or simultaneously administering to the subject one or more agents selected from: one or more immune checkpoint blocking agents; one or more anti-cancer drugs, fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the MVAΔE5R virus with the immune checkpoint blocking agent, anti-cancer drug, and/or fingolimod (FTY720) has a synergistic effect in the treatment of the tumor as compared to administration of either the MVAΔE5R virus or of the immune checkpoint blocking agent, anti-cancer drug, or fingolimod (FTY720) alone.

In one aspect, the present disclosure provides a method of stimulating an immune response comprising administering to a subject an effective amount of the virus or the immunogenic composition. In som e embodiments, the method further comprises separately, sequentially, or simultaneously administering to the subject one or more agents selected from: one or more immune checkpoint blocking agents; one or more anti-cancer drugs; fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the MVAΔE5R virus with the immune checkpoint blocking agent, anti-cancer drug, and/or fingolimod (FTY720) has a synergistic effect in the stimulation of an immune response as compared to administration of the MVAΔE5R virus or of the immune checkpoint blocking agent, anti-cancer drug, or fingolimod (FTY720) alone.

In one aspect, the present disclosure provides a nucleic acid encoding the engineered MVAΔE5R viruses described herein.

In one aspect, the present disclosure provides a kit comprising the engineered MVAΔE5R viruses described herein, and instructions for use.

In one aspect, the present disclosure provides a vaccinia virus (VACV) genetically engineered to comprise a mutant E5R gene (VACVΔE5R). In some embodiments, the virus further comprises a heterologous nucleic acid molecule encoding one or more of OX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of thymidine kinase (TK), C7 (ΔC7L), E3L (ΔE3L), E3LΔ83N, B2R (ΔB2R), B19R (B18R; ΔWR200), IL18BP, K7R, C12L, B8R, B14R, N1L, C11R, K1L, M1L, N2L, or WR199. In some embodiments, the mutant E5R gene comprises replacement of at least a portion of the gene with one or more gene cassettes comprising the heterologous nucleic acid molecule. In some embodiments, the one or more gene cassettes comprises a heterologous nucleic acid molecule encoding OX40L (VACVΔE5R-OX40L). In some embodiments, the one or more gene cassettes further comprises a heterologous nucleic acid molecule encoding human Fms-like tyrosine kinase 3 ligand (hFlt3L) (VACVΔE5R-OX40L-hFlt3L). In some embodiments, the one or more gene cassettes comprises a heterologous nucleic acid molecule encoding human Fms-like tyrosine kinase 3 ligand (hFlt3L) (VACVΔE5R-hFlt3L). In some embodiments, the heterologous nucleic acid is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the virus further comprises a mutant thymidine kinase (TK) gene. In some embodiments, the mutant TK gene comprises replacement of at least a portion of the gene with one or more gene cassettes comprising a heterologous nucleic acid molecule. In some embodiments, the virus further comprises a mutant C7 gene. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid molecule.

In one aspect, the present disclosure provides an immunogenic composition comprising the VACVΔE5R virus. In some embodiments, the immunogenic composition further comprises a pharmaceutically acceptable carrier. In some embodiments, the immunogenic composition further comprises a pharmaceutically acceptable adjuvant.

In one aspect, the present disclosure provides a method for treating a solid tumor in a subject in need thereof, the method comprising delivering to a tumor a composition comprising an effective amount of the VACVΔE5R virus or the immunogenic composition.

In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments, the composition is administered by intratumoral or intravenous injection or a simultaneous or sequential combination of intratumoral and intravenous injection. In some embodiments, the tumor is melanoma, colon, breast, bladder, or prostate carcinoma. In some embodiments, the composition further comprises one or more agents selected from: one or more immune checkpoint blocking agents; one or more anti-cancer drugs; fingolimod (FTY720); and any combination thereof.

In some embodiments, the method further comprises separately, sequentially, or simultaneously administering to the subject one or more agents selected from: one or more immune checkpoint blocking agents; one or more anti-cancer drugs, fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the VACVΔE5R virus with the immune checkpoint blocking agent, anti-cancer drug, and/or fingolimod (FTY720) has a synergistic effect in the treatment of the tumor as compared to administration of the VACVΔE5R virus or of the immune checkpoint blocking agent, anti-cancer drug, or fingolimod (FTY720) alone.

In one aspect, the present disclosure provides a method of stimulating an immune response comprising administering to a subject an effective amount of the virus or the immunogenic composition of. In some embodiments, the method further comprises separately, sequentially, or simultaneously administering to the subject one or more agents selected from: one or more immune checkpoint blocking agents; one or more anti-cancer drugs; fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the VACVΔE5R virus with the immune checkpoint blocking agent, anti-cancer drug, and/or fingolimod (FTY720) has a synergistic effect in the stimulation of an immune response as compared to administration of the VACVΔE5R virus or of the immune checkpoint blocking agent, anti-cancer drug, or fingolimod (FTY720) alone.

In one aspect, the present disclosure provides a nucleic acid encoding the engineered VACVΔE5R viruses of the present technology.

In one aspect, the present disclosure provides a kit comprising the engineered VACVΔE5R viruses of the present technology, and instructions for use.

In one aspect, the present disclosure provides a myxoma virus (MYXV) genetically engineered to comprise a mutant M31R gene (MYXVΔM31R). In some embodiments, tthe virus further comprises a heterologous nucleic acid molecule encoding one or more of OX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of myxoma orthologs of vaccinia virus thymidine kinase (TK), C7 (ΔC7L), E3L (ΔE3L), E3LΔ83N, B2R (ΔB2R), B19R (B18R; ΔWR200), IL18BP, K7R, C12L, B8R, B14R, N1L, C11R, K1L, M1L, N2L, or WR199. In some embodiments, the mutant M31R gene comprises replacement of at least a portion of the gene with one or more gene cassettes comprising the heterologous nucleic acid molecule. In some embodiments, the one or more gene cassettes comprises a heterologous nucleic acid molecule encoding OX40L (MYXVΔM31R-OX40L). In some embodiments, the one or more gene cassettes further comprises a heterologous nucleic acid molecule encoding human Fms-like tyrosine kinase 3 ligand (hFlt3L) (MYXVΔM31R-OX40L-hFlt3L). In some embodiments, the one or more gene cassettes comprises a heterologous nucleic acid molecule encoding human Fms-like tyrosine kinase 3 ligand (hFlt3L) (MYXVΔM31R-hFlt3L). In some embodiments, the heterologous nucleic acid is expressed from within a myxoma ortholog of a vaccinia viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R gene (WR200), the E5R gene, the K7R gene, the C12L gene, the B8R gene, the B14R gene, the N1L gene, the K1L gene, the C16 gene, the M1L gene, the N2L gene, and the WR199 gene. In some embodiments, the virus further comprises a mutant myxoma ortholog of vaccinia virus thymidine kinase (TK) gene. In some embodiments, the mutant TK gene comprises replacement of at least a portion of the gene with one or more gene cassettes comprising a heterologous nucleic acid molecule. In some embodiments, the virus further comprises a mutant myxoma ortholog of vaccinia virus C7 gene. In some embodiments, the mutant C7 gene comprises an insertion of one or more gene cassettes comprising a heterologous nucleic acid molecule. In some embodiments, the mutant C7 gene comprises replacement of all or at least a portion of the gene with one or more gene cassettes comprising a heterologous nucleic acid molecule.

In one aspect, the present disclosure provides an immunogenic composition comprising the MYXVΔM31R virus. In some embodiments, the immunogenic composition further comprises a pharmaceutically acceptable carrier. In some embodiments, the immunogenic composition further comprises a pharmaceutically acceptable adjuvant.

In one aspect, the present disclosure provides a method for treating a solid tumor in a subject in need thereof, the method comprising delivering to a tumor a composition comprising an effective amount of the MYXVΔM31R virus or the immunogenic composition. In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments, the composition is administered by intratumoral or intravenous injection or a simultaneous or sequential combination of intratumoral and intravenous injection. In some embodiments, the tumor is melanoma, colon, breast, bladder, or prostate carcinoma.

In some embodiments, the composition further comprises one or more agents selected from: one or more immune checkpoint blocking agents; one or more anti-cancer drugs; fingolimod (FTY720); and any combination thereof. In some embodiments, the method further comprises separately, sequentially, or simultaneously administering to the subject one or more agents selected from: one or more immune checkpoint blocking agents; one or more anti-cancer drugs, fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the MYXVΔM31R virus with the immune checkpoint blocking agent, anti-cancer drug, and/or fingolimod (FTY720) has a synergistic effect in the treatment of the tumor as compared to administration of either the MYXVΔM31R virus or of the immune checkpoint blocking agent, anti-cancer drug, or fingolimod (FTY720) alone.

In one aspect, the present disclosure provides a method of stimulating an immune response comprising administering to a subject an effective amount of the virus or the immunogenic composition of. In some embodiments, the method further comprises separately, sequentially, or simultaneously administering to the subject one or more agents selected from: one or more immune checkpoint blocking agents; one or more anti-cancer drugs; fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the MYXVΔM31R virus with the immune checkpoint blocking agent, anti-cancer drug, and/or fingolimod (FTY720) has a synergistic effect in the stimulation of an immune response as compared to administration of the MYXVΔM31R virus or of the immune checkpoint blocking agent, anti-cancer drug, or fingolimod (FTY720) alone.

In one aspect, the present disclosure provides a nucleic acid encoding the engineered MYXVΔM31R viruses of the present technology.

In one aspect, the present disclosure provides a kit comprising the engineered MYXVΔM31R viruses of the present technology, and instructions for use.

In one aspect, the present disclosure a vaccinia virus (VACV) genetically engineered to comprise a mutant B2R gene (VACVΔB2R).

In some embodiments, theVACVΔB2R virus further comprises a heterologous nucleic acid molecule encoding one or more of OX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of thymidine kinase (TK), C7 (ΔC7L), E3L (ΔE3L), E3LΔ83N, B19R (B18R; ΔWR200), IL18BP, K7R, C12L, B8R, B14R, N1L, C11R, K1L, M1L, N2L, or WR199. In some embodiments, the VACVΔB2R virus is selected from one or more of VACVΔE3L83NΔB2R, VACVΔE5RΔB2R, VACVΔE3L83NΔE5RΔB2R, VACVΔE3L83N-ΔTK-anti-huCTLA-4-ΔE5R-hFlt3L-OX40L-hIL-12-ΔB2R. In some embodiments, the mutant B2R gene comprises replacement of at least a portion of the gene with one or more gene cassettes comprising the heterologous nucleic acid molecule. In some embodiments, the one or more gene cassettes comprises a heterologous nucleic acid molecule encoding OX40L (VACVΔB2R-OX40L). In some embodiments, the one or more gene cassettes further comprises a heterologous nucleic acid molecule encoding human Fms-like tyrosine kinase 3 ligand (hFlt3L) (VACVΔB2R-OX40L-hFlt3L). In some embodiments, the one or more gene cassettes comprise a heterologous nucleic acid molecule encoding human Fms-like tyrosine kinase 3 ligand (hFlt3L) (VACVΔB2R-hFlt3L). In some embodiments, the heterologous nucleic acid is expressed from within a viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B18R (WR200) gene, the E5R gene, the K7R gene, the C12L gene, the B8R gene, the B14R gene, the N1L gene, the K1L gene, the C16 gene, the M1L gene, the N2L gene, and the WR199 gene.

In some embodiments, the present disclosure provides an immunogenic composition comprising the VACVΔB2R virus. In some embodiments, the immunogenic composition further comprises a pharmaceutically acceptable carrier. In some embodiments, the immunogenic composition further comprises a pharmaceutically acceptable adjuvant.

In some embodiments, the present disclosure provides a method for treating a solid tumor in a subject in need thereof, the method comprising delivering to a tumor a composition comprising an effective amount of the VACVΔB2R virus or the immunogenic composition.

In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject.

In some embodiments, the composition is administered by intratumoral or intravenous injection or a simultaneous or sequential combination of intratumoral and intravenous injection.

In some embodiments, the tumor is melanoma, colon, breast, bladder, or prostate carcinoma.

In some embodiments, the composition further comprises one or more agents selected from: one or more immune checkpoint blocking agents; one or more anti-cancer drugs; fingolimod (FTY720); and any combination thereof. In some embodiments, the method further comprises separately, sequentially, or simultaneously administering to the subject one or more agents selected from: one or more immune checkpoint blocking agents; one or more anti-cancer drugs, fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, in the combination of the VACVΔB2R virus with the immune checkpoint blocking agent, anti-cancer drug, and/or fingolimod (FTY720) has a synergistic effect in the treatment of the tumor as compared to administration of the VACVΔE5R virus or of the immune checkpoint blocking agent, anti-cancer drug, or fingolimod (FTY720) alone.

In some embodiments, the present disclosure provides a method of stimulating an immune response comprising administering to a subject an effective amount of the virus or the immunogenic composition. In some embodiments, the method further comprises separately, sequentially, or simultaneously administering to the subject one or more agents selected from: one or more immune checkpoint blocking agents; one or more anti-cancer drugs; fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the VACVΔB2R virus with the immune checkpoint blocking agent, anti-cancer drug, and/or fingolimod (FTY720) has a synergistic effect in the stimulation of an immune response as compared to administration of the VACVΔB2R virus or of the immune checkpoint blocking agent, anti-cancer drug, or fingolimod (FTY720) alone.

In some embodiments, the present disclosure provides a nucleic acid encoding the VACVΔB2R virus of the present technology.

In some embodiments, the present disclosure provides a kit comprising the VACVΔB2R virus of the present technology, and instructions for use.

In one aspect, the present disclosure provides a myxoma virus (MYXV) genetically engineered to comprise one or more mutants selected from (i) a mutant M63R gene (MYXVΔM63R); (ii) a mutant M64R gene (MYXVΔM64R); and (iii) a mutant M62R gene (MYXVΔM62R). In some embodiments, the virus further comprises a heterologous nucleic acid molecule encoding one or more of OX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or a deletion of any one or more of myxoma orthologs of vaccinia virus thymidine kinase (TK), C7 (ΔC7L), E3L (ΔE3L), E3LΔ83N, B2R (ΔB2R), B19R (B18R; ΔWR200), IL18BP, K7R, C12L, B8R, B14R, N1L, C11R, K1L, M1L, N2L, or WR199 (ΔWR199), or of myxoma M31R (ΔM31R). In some embodiments, the mutant M63R gene, M64R gene, and/or M62R gene comprises replacement of at least a portion of the gene with one or more gene cassettes comprising the heterologous nucleic acid molecule. In some embodiments, the heterologous nucleic acid is expressed from within a myxoma ortholog of a vaccinia viral gene selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the B2R gene, the B18R (WR200) gene, the E5R gene, the K7R gene, the C12L gene, the B8R gene, the B14R gene, the N1L gene, the K1L gene, the C16 gene, the M1L gene, the N2L gene, and the WR199 gene.

In some embodiments, the present disclosure provides an immunogenic composition comprising the MYXV virus of the present technology. In some embodiments, the immunogenic composition further comprises a pharmaceutically acceptable carrier. In some embodiments, the immunogenic composition further comprises a pharmaceutically acceptable adjuvant.

In some embodiments, the present disclosure provides a method for treating a solid tumor in a subject in need thereof, the method comprising delivering to a tumor a composition comprising an effective amount of the MYXV virus of the present technology or the immunogenic composition. In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject. In some embodiments, the composition is administered by intratumoral or intravenous injection or a simultaneous or sequential combination of intratumoral and intravenous injection. In some embodiments, the tumor is melanoma, colon, breast, bladder, or prostate carcinoma.

In some embodiments, the composition further comprises one or more agents selected from: one or more immune checkpoint blocking agents; one or more anti-cancer drugs; fingolimod (FTY720); and any combination thereof. In some embodiments, the method further comprises separately, sequentially, or simultaneously administering to the subject one or more agents selected from: one or more immune checkpoint blocking agents; one or more anti-cancer drugs, fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the MYXVΔM62R, MYXVΔM63R, and/or MYXVΔM64R virus with the immune checkpoint blocking agent, anti-cancer drug, and/or fingolimod (FTY720) has a synergistic effect in the treatment of the tumor as compared to administration of either the MYXVΔM62R, MYXVΔM63R, and/or MYXVΔM64R virus or of the immune checkpoint blocking agent, anti-cancer drug, or fingolimod (FTY720) alone.

In some embodiments, the present disclosure provides a method of stimulating an immune response comprising administering to a subject an effective amount of the virus of or the immunogenic composition. In some embodiments, the method further comprises separately, sequentially, or simultaneously administering to the subject one or more agents selected from: one or more immune checkpoint blocking agents; one or more anti-cancer drugs; fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the MYXV virus with the immune checkpoint blocking agent, anti-cancer drug, and/or fingolimod (FTY720) has a synergistic effect in the stimulation of an immune response as compared to administration of the MYXV virus or of the immune checkpoint blocking agent, anti-cancer drug, or fingolimod (FTY720) alone.

In some embodiments, the present disclosure provides a nucleic acid encoding the MYXV virus.

In some embodiments, the virus further comprises a heterologous nucleic acid molecule encoding hIL-12. In some embodiments, the virus comprises MVAΔE3LΔE5R-hFlt3L-OX40LΔWR199-hIL-12. In some embodiments, the virus further comprises a mutant C11R gene (MVAΔE3LΔE5R-hFlt3L-OX40LΔWR199-hIL-12ΔC11R). In some embodiments, the virus further comprises a nucleic acid molecule encoding hIL-15/IL-15Rα. In some embodiments, the virus further comprises a mutant ΔE3L83N, a mutant thymidine kinase (ΔTK), a mutant B2R (ΔB2R), a mutant WR199 (ΔWR199), and a mutant WR200 (ΔSR200), and comprising a nucleic acid molecule encoding anti-CTLA-4 and a nucleic acid molecule encoding IL-12 (VACVΔE3L83N-ΔTK-anti-CTLA-4-ΔE5R-hFlt3L-OX40L-IL-12ΔB2RΔWR199ΔWR200). In some embodiments, the VACVΔE3L83N-ΔTK-anti-CTLA-4-ΔE5R- hFlt3L-OX40L-IL-12ΔB2RΔWR199ΔWR200 virus further comprises a nucleic acid molecule encoding hIL-15/IL-15Rα (VACVΔE3L83N-ΔTK-anti-CTLA-4-ΔE5R-hFlt3L-OX40L-IL-12ΔB2RΔWR199ΔWR200-hIL-15/IL-15Rα). In some embodiments, the VACVΔE3L83N-ΔTK-anti-CTLA-4-ΔE5R-hFlt3L-OX40L-IL-12ΔB2RΔWR199ΔWR200 virus further comprises a mutant C11R gene (ΔC11R) (VACVΔE3L83N-ΔTK-anti-CTLA-4-ΔE5R-hFlt3L-OX40L-IL-12ΔB2RΔWR199ΔWR200ΔC11R). In some embodiments, the VACVΔE3L83N-ΔTK-anti-CTLA-4-ΔE5R-hFlt3L-OX40L-IL-12ΔB2RΔWR199ΔWR200ΔC11R virus further comprises a nucleic acid molecule encoding hIL-15/IL-15Rα (VACVΔE3L83N-ΔTK-anti-CTLA-4-ΔE5R-hFlt3L-OX40L-IL-12ΔB2RΔWR199ΔWR200-hIL-15/IL-15Rα ΔC11R).

In some embodiments, MYXV viruses of the present technology are genetically engineered to comprise a mutant M62R gene (ΔM62R), a mutant M63R gene (ΔM63R), and a mutant M64R gene (ΔM64R) (MYXVΔM62RΔM63RΔM64R).

In one aspect, the present disclosure provides a recombinant poxvirus selected from the group consisting of: MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3L-ΔE5R-hFlt3L-mOX40LΔWR199-hIL-12ΔC11R-hIL-15/IL-15α, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63-RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔ-M31R-hFlt3L-OX40L-IL-12-IL-15/IL-15Rα, MYXVΔM-62RΔM63RΔM64RΔM31R-hFlt3L-OX40L-IL-12-CTLA-4, and MYXVΔM62RΔM63RΔM64RΔM31R-hFlt3L-OX40L-IL-12-IL-15/IL-15Rα-CTLA-4.

In some embodiments, the present disclosure provides a nucleic acid sequence encoding the recombinant poxvirus.

In some embodiments, the present disclosure provides a kit comprising the recombinant poxvirus.

In some embodiments, the present disclosure provides an immunogenic composition comprising the recombinant poxvirus. In some embodiments, the immunogenic composition further comprises a pharmaceutically acceptable carrier. In some embodiments, theimmunogenic composition further comprises a pharmaceutically acceptable adjuvant.

In some embodiments, the present disclosure provides a method for treating a solid tumor in a subject in need thereof, the method comprising delivering to a tumor a composition comprising an effective amount of the recombinant poxvirus or the immunogenic composition. In some embodiments, the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells, or prolonging survival of the subject.

In some embodiments, the composition is administered by intratumoral or intravenous injection or a simultaneous or sequential combination of intratumoral and intravenous injection.

In some embodiments, the tumor is melanoma, colon, breast, bladder, or prostate carcinoma.

In some embodiments, the composition further comprises one or more agents selected from: one or more immune checkpoint blocking agents; one or more anti-cancer drugs; fingolimod (FTY720); and any combination thereof. In some embodiments, the method further comprises separately, sequentially, or simultaneously administering to the subject one or more agents selected from: one or more immune checkpoint blocking agents; one or more anti-cancer drugs, fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises. anti-PD-1 antibody. In some embodiments, the one or more immune checkpoint blocking agents comprises anti-CTLA-4 antibody. In some embodiments, the combination of the recombinant poxvirus with the immune checkpoint blocking agent, anti-cancer drug, and/or fingolimod (FTY720) has a synergistic effect in the treatment of the tumor as compared to administration of the recombinant poxvirus or of the immune checkpoint blocking agent, anti-cancer drug, or fingolimod (FTY720) alone.

In some embodiments, the present disclosure provides a method of stimulating an immune response comprising administering to a subject an effective amount of the virus or the immunogenic composition. In some embodiments, the method further comprises separately, sequentially, or simultaneously administering to the subject one or more agents selected from: one or more immune checkpoint blocking agents; one or more anti-cancer drugs; fingolimod (FTY720); and any combination thereof. In some embodiments, the one or more immune checkpoint blocking agents is selected from the group consisting of anti-PD-L1 antibody, anti-PD-1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof; and/or the one or more anti-cancer drugs is selected from the group consisting of a Mek inhibitor (U0126, selumitinib (AZD6244), PD98059, trametinib, cobimetinib), an EGFR inhibitor (lapatinib (LPN), erlotinib (ERL)), a HER2 inhibitor (lapatinib (LPN), Trastuzumab), a Raf inhibitor (sorafenib (SFN)), a BRAF inhibitor (dabrafenib, vemurafenib), an anti-OX40 antibody, a GITR agonist antibody, an anti-CSFR antibody, a CSFR inhibitor, paclitaxel, TLR9 agonist CpG, and a VEGF inhibitor (Bevacizumab), and any combination thereof. In some embodiments, the one or more immune checkpoint blocking agents comprises anti-PD-L1 antibody. In some embodiments, the one or more immune checkpoint blocking agents comprises anti-PD-1 antibody. In some embodiments, the one or more immune checkpoint blocking agents comprises anti-CTLA-4 antibody. In some embodiments, the combination of the recombinant poxvirus with the immune checkpoint blocking agent, anti-cancer drug, and/or fingolimod (FTY720) has a synergistic effect in the stimulation of an immune response as compared to administration of the recombinant poxvirus or of the immune checkpoint blocking agent, anti-cancer drug, or fingolimod (FTY720) alone.

BRIEF DESCRIPTION OF THE DRAWINGS

FIG. 2A is an image of PCR amplification of mOX40L gene and TK gene in MVAΔE3L and MVAΔE3L-TK(−)-mOX40L viral genome. FIG. 2B: Representative FACS plots showing the expression of mOX40L in B16-F10 cells infected with MVAΔE3L-TK(−)-mOX40L. Briefly, B16-F10 murine melanoma cells were infected at a MOI of 10 for 24 hours. Cells were then stained with PE-conjugated anti-mOX40L antibody.

FIGS. 3A-3C: Representative dot plots of Granzyme $B^+$ $CD8^+$ T cells in none-injected tumors after treatment with either MVAΔE3L, MVAΔE3L-OX40L, or PBS. FIG. 3D: Graph of percentages of Granzyme $B^+$ $CD8^{30}$ T cells out of $CD8^+$ cells. Data are means ±SEM (n=3 or 4). (P<0.01; t test). FIGS. 3E-3G: Representative dot plots of Granzyme $B^+$ $CD4^+$ T cells in non-injected tumors after treatment with MVAΔE3L, MVAΔE3L-OX40L, or PBS. FIG. 3H: Graph of percentages of Granzyme $B^+$ $CD4^+$ T cells out of $CD4^+$ cells. Data are means ±SEM (n=3 or 4). (P<0.01; ***P<0.001, t test).

FIG. 4A: Image of ELISPOT of triplicate samples from left to right. FIG. 4B: Graph of IFN-$\gamma^+$ spots per 300,000 purified $CD8^+$ T cells. Each bar represents spleen sample from individual mouse (n=3 or 4).

FIG. 5A: First step: homologous recombination between plasmid DNA pUC57 vector and MVA viral genomic DNA at the C6 and C8 gene flanking C7 locus to insert hFlt3L and GFP expression cassette into the C7 locus (replacing C7 gene). The human Flt3L gene is under the control of the vaccinia synthetic early and late promoter (PsE/L). GFP is under the control of the vaccinia P7.5 promoter. FIG. 5B: Second step: homologous recombination between plasmid DNA pCB vector and MVAΔC7L-hFlt3L viral genomic DNA at the TK (J2R) gene locus to insert muOX40L and drug selection marker expression cassette into the TK (J2R) gene locus. The murine OX40L gene is under the control of the vaccinia synthetic early and late promoter (PsE/L). The drug selection marker gpt is under the control of the vaccinia P7.5 promoter.

FIG. 8A: Representative dot plots of Granzyme $B^+$ $CD8^+$ T cells in none-injected tumors after treatment with either PBS, MVAΔC7L, MVAΔC7L-hFlt3L, MVAΔC7L-hFlt3L-muOX40L, or Heat-iMVAΔC7L-hFlt3L. FIG. 8B: Graph of the absolute numbers of $CD8^+$ T cells per gram of distant non-injected tumors. Data are means ±SEM (n=4 or 5). (*P<0.05; P<0.01; t test). FIG. 8**C: Graph of the absolute numbers of Granzyme $B^+$ $CD8^+$ T cells per gram of distant non-injected tumors. Data are means ±SEM (n=4 or 5). (*P<0.05; ** P<0.01; t test).

FIG. 9A: Representative dot plots of Granzyme $B^+$ $CD4^+$ T cells in none-injected tumors after treatment with either PBS, MVAΔC7L, MVAΔC7L-hFlt3L, MVAΔC7L-hFlt3L-muOX40L, or Heat-iMVAΔC7L-hFlt3L. FIG. 9B: Graph of the absolute numbers of $CD4^+$ T cells per gram of distant non-injected tumors. Data are means ±SEM (n=4 or 5). (*P<0.05; P<0.01; t test). FIG. 9**C: Graph of the absolute numbers of Granzyme $B^+$ $CD4^+$ T cells per gram of distant non-injected tumors. Data are means ±SEM (n=4 or 5). (*P<0.05; **P<0.01; t test).

FIG. 10A: Image of ELISPOT of triplicate samples from left to right. FIG. 10B: Graph of IFN-$\gamma^+$ spots per 300,000 purified $CD8^+$ T cells. Each bar represents spleen sample from individual mouse (n=5).

FIG. 11A is a scheme of tumor implantation and treatment for a B16-F10 bilateral tumor implantation model. Briefly, B16-F10 melanoma cells were implanted intradermally to the left and right flanks of C57B/6J mice ($5\times10^5$ to the right flank and $1\times10^5$ to the left flank). Nine days post tumor implantation, intratumoral injections ($2\times10^7$ pfu) of MVAΔC7L-hFlt3L-TK(−)mOX40L were performed twice weekly to the larger tumors on the right flank. Anti-CTLA-4 or anti-PD-L1 antibody at 250 μg per mouse was given intraperitoneally. The tumor sizes were measured and the survival of mice was monitored. FIGS. 11B and 11C are graphical representations of data showing volumes of injected (FIG. 11B) and non-injected (FIG. 11C) tumors over days after PBS, MVAΔC7L-hFlt3L-TK(−)-mOX40L, MVAΔC7L-hFlt3L-TK(−)-mOX40L plus anti-CTLA-4 antibody, MVAΔC7L-hFlt3L-TK(−)-mOX40L plus anti-PD-L1 antibody treatments. FIGS. 11D and 11E are graphical representations of data showing initial volumes of injected (FIG. 11D) and non-injected (FIG. 11E) tumors and at Day 7 and Day 11 post PBS, MVAΔC7L-hFlt3L-TK(−)-mOX40L, MVAΔC7L-hFlt3L-TK(−)-mOX40L plus anti-CTLA-4 antibody, MVAΔC7L-hFlt3L-TK(−)-mOX40L plus anti-PD-L1 antibody treatments. FIG. 11F is a graph of the Kaplan-Meier survival curve of tumor-bearing mice treated with either PBS, MVAΔC7L-hFlt3L-TK(−)-mOX40L, MVAΔC7L-hFlt3L-TK(−)-mOX40L plus anti-CTLA-4 antibody, MVAΔC7L-hFlt3L-TK(−)-mOX40L plus anti-PD-L1 antibody treatments. (n=10, P<0.01; *P<0.001; Mantel-Cox test). FIG. 11G is a table showing median survival of mice treated with either PBS, MVAΔC7L-hFlt3L-TK(−)-mOX40L, MVAΔC7L-hFlt3L-TK(−)-mOX40L plus anti-CTLA-4 antibody, MVAΔC7L-hFlt3L-TK(−)-mOX40L plus anti-PD-L1 antibody.

FIG. 13A: First step: homologous recombination between plasmid DNA pUC57 vector and MVA viral genomic DNA at the C6 and C8 gene flanking C7 locus to insert hFlt3L and GFP expression cassette into the C7 locus (replacing C7 gene). The human Flt3L gene is under the control of the vaccinia synthetic early and late promoter (PsE/L). GFP is under the control of the vaccinia P7.5 promoter. FIG. 13B: Second step: homologous recombination between plasmid DNA pUC57ΔTK-hOX40L-mCherry and MVAΔC7L-hFlt3L viral genomic DNA at the J1R and J3R (TK-R and TK-L) loci flanking J2R (TK) gene to insert huOX40L and mCherry expression cassette into the TK (J2R) gene locus. The human OX40L gene is under the control of the vaccinia synthetic early and late promoter (PsE/L). mCherry is under the control of the vaccinia P7.5 promoter.

FIG. 14A is a multi-step growth curve of these viruses in CEFs. Briefly, CEFs were infected with the above-mentioned viruses at a MOI of 0.05. Cells were collected at 1, 24, 48 and 72 h. Viral titers were determined on BHK21 cells by serial dilution and counting GFP* foci under confocal microscope. FIG. 14B show the log (fold change) of viral titers at 72 h post infection over 1 h post infection.

FIG. 15A: BHK21 cells were either mock-infected, or infected with MVAΔC7L-hFlt3L or with MVAΔC7L-hFlt3L-TK(−)-hOX40L at a MOI of 10. Cells were collected at 24 h post infection and stained with PE-conjugated anti-hOX40L antibody prior to FACS analyses. FIG. 15B: human moDCs were either treated with poly I:C at 10 μg/ml, or infected with Heat-iMVA, MVAΔC7L-TK(−), or MVAΔC7L-hFlt3L-TK(−)-hOX40L at MOI of 1. At 24 h post infection, cells were collected and stained with PE-conjugated anti-hOX40L antibody prior to FACS analyses. Untreated murine B16-F10 melanoma cells were used as a negative control.

FIGS. 19A-19C: HEK293T cells were transfected with plasmids expressing IFNβ-luc reporter, murine cGAS, human STING and vaccinia virus ORFs as indicated. Dual luciferase assays were performed 24 h after transfection. Adenovirus E1A gene was used as a positive control.

FIG. 20A: Mouse cGAS was co-transfected with expression plasmids. FIG. 20B: Human cGAS was co-transfected with expression plasmids. FIG. 20C: Mouse cGAS was co-transfected with FLAG-tagged vaccinia ORFs of K7R, E5R, B14R, C11R, and B18R. FIGS. 20D and 20E are charts showing the induction of IFNB in cells over-expressing E5, B14, K7, or B18 by Heat-iMVA infection (FIG. 20D) or ISD treatment (FIG. 20E).

FIG. 22 shows MVA genome sequence as set forth in SEQ ID NO: 1, and given by GenBank Accession No. U94848.1.

FIG. 23 shows the vaccinia virus (Western Reserve strain; WR) genome sequence as set forth in SEQ ID NO: 2, and given by GenBank Accession No. AY243312.1.

FIG. 24A is a multi-step growth of these viruses in B16-F10 cells. Briefly, B16-F10 cells were infected with the above-mentioned viruses at a MOI of 0.1. Cells were collected at 1, 24, 48, and 72 h post infection and viral yields (log pfu) were determined by titrating on BSC40 cells. Viral yields were plotted against hours post infection. FIG. 24B shows the log (fold change) of viral titers at 72 h post infection over 1 h post infection.

FIG. 26 shows the surface expression of murine OX40L protein in E3LΔ83N-TK⁻-hFlt3L-anti-muCTLA-4/C7L⁻-mOX40L or VAC-TK⁻-anti-mCTLA-4/C7L⁻-mOX40L virus infected murine B16-F10 melanoma cells. Briefly, B16-F10 cells were infected or mock infected with E3LΔ83N-TK⁻-vector, E3LΔ83N-TK⁻-hFlt3L-anti-muCTLA-4/C7L⁻-vector, E3LΔ83N-TK⁻-hFlt3L-anti-muCTLA-4/C7L⁻-mOX40L, or VAC-TK⁻-anti-mCTLA-4/C7L⁻-mOX40L viruses at a MOI of 5. Cells were collected at 24 h post infection, and stained with PE-conjugated anti-mOX40L antibody, and analyzed by FACS. Data were analyzed with FlowJo software (FlowJo, Becton-Dickinson, Franklin Lakes, NJ).

FIG. 27 shows a scheme of tumor implantation and treatment for a B16-F10 murine melanoma unilateral tumor implantation model. Briefly, $5\times10^5$ B16-F10 melanoma cells were implanted intradermally to the right flank of C57B/6J mice. Nine days post tumor implantation, $4\times10^7$ pfu of MVAΔC7L-hFlt3L-TK(−)mOX40L were intratumorally injected twice weekly. Anti-PD-L1 antibody at 250 μg per mouse was given intraperitoneally. The tumor sizes were measured and the survival of mice was monitored.

FIGS. 28A-28C are graphical representations of data showing volumes of tumors over days after PBS (FIG. 28A), MVAΔC7L-hFlt3L-TK(−)-mOX40L (FIG. 28B), or MVAΔC7L-hFlt3L-TK(−)-mOX40L plus anti-PD-L1 antibody (FIG. 28C) treatments.

FIGS. 29A and 29B demonstrate survival studies of mice treated with either PBS, MVAΔC7L-hFlt3L-TK(−)-mOX40L, or MVAΔC7L-hFlt3L-TK(−)-mOX40L plus anti-PD-L1 antibody. FIG. 29A is a graph of the Kaplan-Meier survival curve of tumor-bearing mice treated with either PBS, MVAΔC7L-hFlt3L-TK(−)-mOX40L, or MVAΔC7L-hFlt3L-TK(−)-mOX40L plus anti-PD-L1 antibody treatments. (n=5~10, P<0.01; *P<0.001; Mantel-Cox test). FIG. 29B is a table showing median survival of mice treated with either PBS, MVAΔC7L-hFlt3L-TK(−)-mOX40L, MVAΔC7L-hFlt3L-TK(−)-mOX40L plus anti-PD-L1 antibody.

FIGS. 31A-31C are graphical representations of data showing volumes of tumors over days after PBS (FIG. 31A), MVAΔC7L-hFlt3L-TK(−)-mOX40L (FIG. 31B), or MVAΔC7L-hFlt3L-TK(−)-mOX40L plus anti-PD-L1 antibody (FIG. 31C) treatments.

FIGS. 32A and 32B demonstrate survival studies of mice treated with either PBS, MVAΔC7L-hFlt3L-TK(−)-mOX40L, or MVAΔC7L-hFlt3L-TK(−)-mOX40L plus anti-PD-L1 antibody. FIG. 32A is a graph of the Kaplan-Meier survival curve of tumor-bearing mice treated with either PBS, MVAΔC7L-hFlt3L-TK(−)-mOX40L, or MVAAC7L-hFlt3L-TK(−)-mOX40L plus anti-PD-L1 antibody treatments. (n=4~8, P<0.01; *P<0.001; Mantel-Cox test). FIG. 32B is a table showing median survival of mice treated with either PBS, MVAΔC7L-hFlt3L-TK(−)-mOX40L, or MVAΔC7L-hFlt3L-TK(−)-mOX40L plus anti-PD-L1 antibody.

FIG. 35A is a graph of the Kaplan-Meier survival curve of tumor-bearing mice treated with either PBS, MVAΔC7L-hFlt3L-TK(−)-mOX40L, MVAΔC7L-hFlt3L-TK(−)-mOX40L plus anti-PD-L1 antibody, or anti-PD-L1 antibody treatments. (n=10, *P<0.05, P<0.01; *P<0.001; Mantel-Cox test). FIG. 35B is a table showing median survival of mice treated with either PBS, MVAΔC7L-hFlt3L-TK(−)-mOX40L, MVAΔC7L-hFlt3L-TK(−)-mOX40L plus anti-PD-L1 antibody, or anti-PD-L1 antibody.

FIG. 50A is adapted from a drawing in Gong et al. *Front. Immunol.* (2014), Naïve T cells circulate between lymphoid organs and blood. Upon infection or tumor implantation, antigen-presenting cells present antigen to prime cognate T cells, which then proliferate and differentiate into effector T cells and memory T cells. Effector T cells are recruited to the site of infection or tumors and memory T cells recirculate. FTY720 (FIG. 50B), a sphingosine-1-phosphate receptor modulator, blocks the exit of lymphocytes from lymphoid organs.

FIG. 54A is a schematic diagram of vaccinia E5. E5 is 328-aa protein, which is comprised of a N-terminal domain followed by two BEN domains. BEN is named after its presence in BANP/SMAR1, poxvirus E5R, and NAC1. BEN domain containing proteins are involved in chromatin organization, transcription regulation, and possibly viral DNA organization. FIG. 54B is a schematic diagram that demonstrates that vaccinia E5 is highly conserved in the poxvirus family.

FIG. 55A shows a scheme for generating VACVΔE5R virus through homologous recombination at the E4L and E6R loci flanking ER gene of the vaccinia genome. FIG. 55B shows weight loss over days after intranasal infection with either WT VACV ($2\times10^6$ pfu), VACVΔE5R ($2\times10^6$ pfu), or VACVΔE5R ($2\times10^7$ pfu). FIG. 55C shows Kaplan-Meier survival curves of mice infected with WT VACV ($2\times10^6$ pfu) or VACVΔE5R ($2\times10^6$ pfu or $2\times10^7$ pfu).

FIG. 56A shows RT-PCR results of BMDCs that were infected MVA, VACV, or VACVΔE5R at a MOI of 10. Cells were collected at 8 h post infection. RNAs were extracted and RT-PCRs were performed. FIG. 56B shows that BMDCs were infected MVA, VACV, or VACVΔE5R at a MOI of 10. Supernatants were collected at 21 h post infection. IFN-ß protein levels were determined by ELISA.

FIG. 57A shows a scheme for generating MVAΔE5R virus through homologous recombination at the E4L and E6R loci flanking E5R gene of the MVA genome. FIG. 57B shows a scheme for generating MVAΔK7R virus through homologous recombination at the K5,6L and FIL loci flanking K7R gene of the MVA genome. FIG. 57C show that BMDCs were infected with either MVA, MVAΔE5R, or MVAΔK7R at MOI of 10. Cells were collected at 6 h post infection. IFNB gene expression was measured by RT-PCR. FIG. 57D shows that BMDMs were infected with either MVA, MVAΔE5R, or MVAΔK7R at MOI of 10. Cells were collected at 6 h post infection. IFNB gene expression was measured by RT-PCR.

FIG. 59A and 59B show real-time quantitative PCR (RT-PCR) analyses of IFNB (FIG. 59A) and viral E3R (FIG. 59B) gene expression induced by MVAΔE5R or Heat-inactivated MVAΔE5R ("Heat-iMVAΔE5R"). BMDCs were generated by culturing bone marrow cells in the presence of mGM-CSF. Cells were infected with either MVAΔE5R or Heat-iMVAΔE5R virus at MOIs of 0.25, 1, 3, or 10. Cells were washed after 1 h infection and fresh medium was added. Cells were collected at 14 h post infection. IFNB and E3 gene expressions were determined by RT-PCR. FIG. 59C BMDCs were infected with either MVAΔE5R or Heat-iMVAΔE5R virus at MOIs of 0.25, 1, 3, or 10. Supernatants were collected at 14 h post infection. The concentrations of IFN-β in the supernatants were measured by ELISA.

FIG. 60A shows IFNA induction by MVAΔE5R in WT and $cGAS^{-/-}$ BMDCs. FIG. 60B shows IFNA induction by MVAΔE5R in WT and $cGAS^{-/-}$ BMDCs. FIG. 60C shows vaccinia E3R gene expression in WT and $cGAS^{-/-}$ BMDCs infected with MVAΔE5R. BMDCs were infected with either MVA or MVAΔE5R at a MOI of 10. Cells were collected at 6 h post infection. RNAs were extracted. Real-time quantitative PCR analysis was performed. FIG. 60D shows MVAΔE5R induces higher levels of IFN-β protein secretion compared with Heat-iMVA or Heat-iMVAΔE5R, and the induction is completely dependent on cGAS. WT or $cGAS^{-/-}$ BMDCs were infected with either MVA, MVAΔE5R at a MOI of 10, Heat-iMVA, or Heat-iMVAΔE5R at an equivalent of MOI. Supernatants were collected at 8 and 16 h post infection. IFN-protein levels in the supernatants were measured by ELISA.

FIG. 61A show BMDCs from WT or $STING^{Gt/Gt}$ mice were infected with either MVA, MVAΔE5R, or Heat-iMVAΔE5R. Cells were collected at 8 h post infection and RT-PCR analysis was performed. Fold induction of IFNB gene expression is shown. FIG. 61B shows bone marrow derived macrophages (BMDMs) were generated by culturing bone marrow cells from WT and $STING^{Gt/Gt}$ mice in the presence of M-CSF (macrophage colony stimulating factor). BMDMs were infected with either MVA, MVAΔE5R, Heat-iMVA, or Heat-iMVAΔE5R. Supernatants were collected at 16 h post infection and IFN-β protein levels were measured by ELISA.

FIG. 62A shows that WT or $IRF3^{-/-}$ BMDCs were infected with either MVA, MVAΔE5R, Heat-iMVA, or Heat-iMVAΔE5R. Supernatants were collected at 8 and 16 h post infection. IFN-β levels were determined by ELISA. FIG. 62B shows that WT or $IRF3^{-/-}$ BMDMs were infected with either MVA, MVAΔE5R, Heat-iMVA, or Heat-iMVAΔE5R. Supernatants were collected at 8 and 16 h post infection. IFN-β levels were determined by ELISA. FIG. 62C shows that WT or $IRF7^{-/-}$ BMDCs were infected with MVAΔE5R at a MOI of 10. Supernatants were collected at 21 h post infection. IFN-β levels in the supernatants were determined by ELISA. FIG. 62D shows that WT, $cGAS^{-/-}$, or $IFNAR^{-/-}$ BMDCs were infected with either MVA, MVAΔE5R, Heat-iMVA, or Heat-IMVAΔE5R. Supernatants were collected at 16 h post infection. IFN-β levels were determined by ELISA.

FIG. 63A shows that murine embryonic fibroblasts were pretreated with either cycloheximide (CHX), a proteasomal inhibitor, MG132, a pan-caspase inhibitor, Z-VAD, or an AKT1/2 inhibitor VIII for 30 min. MEFs were then infected with WT VACV in the presence of each drug. Cells were collected at 6 h post infection. Western blot analysis was performed with anti-cGAS and anti-GAPDH antibodies. FIG. 63B shows that MEFs were treated with DMSO or MG132. Cells were collected at 2, 4, and 6 h post treatment. Western blot analysis was performed with anti-cGAS and anti-GAPDH antibodies. FIG. 63C demonstrates that WT VACV infection of BMDCs resulted in cGAS degradation, whereas VACVΔE5R did not. In the presence of MG132, WT VACV-induced cGAS degradation was blocked. BMDCs were infected with WT VACV or VACV at MOI of 10 in the presence or absence of MG132. Cells were collected at 2, 4, and 6 h post infection. Western blot analyses were performed using anti-cGAS and anti-GAPDH antibodies.

FIG. 67A shows $1.2\times10^5$ pDCs ($B220^+PDCA-1^+$) sorted from splenocytes were infected with either MVA, Heat-iMVA, or MVAΔE5R. Non-infected splenocytes were included as a control. Supernatants were collected at 18 h post infection. IFN-β levels in the supernatants were measured by ELISA. FIG.67B shows $4\times10^5$ pDCs ($B220^+PDCA-1^+$) sorted from Flt3L-BMDCs were infected with either MVA, Heat-iMVA, or MVAΔE5R. Non-infected sorted pDCs were included as a control. Supernatants were collected at 18 h post infection. IFN-levels in the supernatants were measured by ELISA.

FIG. 73 shows IFN-γ levels in the supernatants of the BMDC: T cells co-culture.

FIG. 75A is a scheme of vaccination strategy. On day 0, C57BL/6J mice were vaccinated with MVA-OVA or MVAΔE5R-OVA at $2\times10^7$ pfu either through skin scarification or intradermal injection. Spleens were harvested from euthanized mice one week later and co-cultured with OVA257-264 (SIINFEKL) peptide (10 μg/ml) pulsed BMDCs for 12 h. The intracellular IFN-γ levels in $CD8^+$ T cells was then measured by flow cytometry. (* $p<0.05$;  $p<0.01$). FIG. 75B shows activated $CD8^+$ T cells after vaccination through skin scarification with MVA-OVA or MVAΔE5R-OVA. FIG. 75**C shows activated $CD8^+$ T cells after vaccination through intradermal injection of MVA-OVA or MVAΔE5R-OVA.

FIG.76A shows RT-PCR results of IFNB gene expression in WT and $cGAS^{-/-}$ cells. FIG. 76B shows IFN-β protein levels in the supernatants of infected WT and $cGAS^{-/-}$ cells as measured by ELISA.

FIG. 77A shows DNA copy numbers in MVA-infected WT, $cGAS^{-/-}$ or $IFNAR1^{-/-}$ skin dermal fibroblasts. FIG. 77B shows the fold-change compared with the DNA copy numbers at 1 h post infection with MVA. FIG. 77C shows DNA copy numbers in MVAΔE5R-infected WT, $cGAS^{-/-}$ or $IFNAR1^{-/-}$ skin dermal fibroblasts. FIG. 77D shows the fold-change compared with the DNA copy numbers at 1 h post infection with MVAΔE5R.

FIG. 78A shows MVA titers over time after infection in WT, $cGAS^{-/-}$ or $IFNAR1^{-/-}$ skin dermal fibroblasts. FIG. 78 shows the fold-change compared with the viral titers at 1 h post infection with MVA. FIG. 78C shows MVAΔE5R titers over time after infection in WT, $cGAS^{-/-}$ or $IFNAR1^{-/-}$ skin dermal fibroblasts. FIG. 78D shows the fold-change compared with the viral titers at 1 h post infection with MVAΔE5R.

FIG. 79A shows RT-PCR results of IFNB induction by MVAΔE5R in WT B16-F10 murine melanoma cells and $STING^{-/-}$ B16-F10 cells. WT and $STING^{-/-}$ B16-F10 cells were infected with either MVA or MVAΔE5R at a MOI of 10. Cells were collected at 18 h post infection. RNAs were extracted and quantitative real-time PCR analysis was performed. FIG. 79B shows ELISA results of IFN-β protein levels in the supernatants of WT and $STING^{-/-}$ B16-F10 cells infected with either MVA or MVAΔE5R collected at 18 h post infection.

FIG. 83A are dot plots of FACS analysis of hFlt3L expression on the Y axis and hOX40L expression on the X axis of BHK21cells infected with either MVA or MVAΔE5R-hFlt3L-hOX40LhOX40L for 24 h. Cells were infected at a MOI of 10. A mock infection, no virus control was included. FIG. 83B are dot plots of FACS analysis of hFlt3L expression on the Y axis and hOX40L expression on the X axis of murine B16-F10 melanoma infected with either VA or MVAΔE5R-hFlt3L-hOX40L for 24 h. Cells were infected at a MOI of 10. A mock infection, no virus control was included. FIG. 83C are dot plots of FACS analysis of hFl3L expression on the Y axis and hOX40L expression on the X axis of human melanoma cells SK-MEL28 infected with either MVA or MVAΔE5R-hFlt3L-hOX40LhOX40L for 24 h. Cells were infected at a MOI of 10. A mock infection, no virus control was included.

FIG. 85A shows a schematic diagram of pCB vector with a single expression cassette designed to express the heavy chain and light of the antibody using the vaccinia viral synthetic early and late promoter (PsE/L). The coding sequence of the heavy chain (mulgG2a) and the light chain of 9D9 was separated by a cassette including a furin cleavage site followed by a 2A peptide (Pep2A) sequence to enables ribosome skipping. The pCB plasmid containing the anti-mu-CTLA-4 gene under the control of the vaccinia PsE/L as well as the *E. coli* xanthine-guanine phosphoribosyl transferase gene (gpt) under the control of vaccinia P7.5 promoter flanked by the thymidine kinase (TK) gene on either side. Recombinant virus expressing anti-mu-CTLA-4 from TK locus was generated through homologous recombination at the TK locus between pCB plasmid DNA and viral genomic DNA. FIG. 85B is the schematic diagram of using the vaccinia viral synthetic early and late promoter (PsE/L) to express both human Flt3L and murine OX40L as a fusion protein in a single expression cassette. The coding sequence of human Flt3L and murine OX40L was separated by a cassette including a furin cleavage site followed by a 2A peptide (Pep2A) sequence. A pUC57 plasmid containing human Flt3L and murine OX40L fusion gene flanked by the E4L and E6R genes on either side was constructed. Recombinant virus expressing human Flt3L and murine OX40L fusion protein from E5R locus was generated through homologous recombination at E4L and E6R loci between pUC57 plasmid and viral genomic DNA.

FIG. 86A shows the schematic diagram of the primers used to amplify the different gene fragments from the inserted expression cassette of pUC57 expression plasmid. Primer pair f1/r1 was used to generate a 2795 bp PCR fragment, which contains the whole expression cassette. This primer pair was also used to check the purity of the recombinant virus. Primer pair f0/r5 was used to confirm the expression cassette was inserted into the right position in virus genome. Human Flt3L gene was amplified using primer pair f1/r3 or fo/r2 from VACV-TK$^-$-anti-muCTLA-4-E5R$^-$-hFl3L-mOX40L. Murine OX40L gene was generated using primer pair f4/r1. And finally, pCB-R4 and TK-F5 primer pair was used to generate the anti-mu-CTLA-4 gene inserted in TK locus from VACV-TK$^-$-anti-muCTLA-4-E5R$^-$-hFl3L-mOX40L or MVA-TK$^-$-anti-muCTLA-4-E5R$^-$-hFl3L-mOX40L recombinant virus. FIG. 86B shows the gel image of the PCR results using the primer pairs described in FIG. 86A and a table that displays the predicated sizes of the amplified DNA fragments with the primer pairs. FIG. 86C shows Western blot results of human SK-MEL-28 melanoma cells mock infected or infected with E3LΔ83N-TK$^-$-vector, E3LΔ83N-TK$^-$-hFl3L-anti-muCTLA-4, E3LΔ83N-TK$^-$-hFl3L-anti-muCTLA-4-C7L$^-$-mOX40L, VACV, VACV-TK$^-$-anti-muCTLA-4-C7L$^-$-mOX40L, or VACV-TK$^-$-anti-muCTLA-4-E5R$^-$-hFl3L-mOX40L at a MOI of 10. Cell lysates were collected at 24 hours post-infection, and polypeptides were separated using 10% SDS-PAGE. HRP-linked anti-mouse IgG (heavy and light chain) antibody was used to detect full-length (FL), heavy chain (HC), and light chain (LC) of anti-muCTLA-4 antibodies.

FIG. 87 shows the protein sequence alignments of E5 orthologs from multiple members of the poxvirus family. Figure discloses SEQ ID NOs: 42-54, 20 and 55-60, respectively, in order of appearance.

FIG. 88A shows the protein sequence alignments of E5 from vaccinia virus and Modified vaccinia virus Ankara (MVA). Figure discloses SEQ ID NOs: 20 and 58, respectively, in order of appearance. FIG. 88B shows the protein sequence alignments of E5 from vaccinia virus and myxoma virus. Figure discloses SEQ ID NOs: 20-21, respectively, in order of appearance.

FIG. 89A shows that HEK293T cells were transfected with plasmids expressing murine cGAS, human STING together with either E5R, M31R or pcDNA vector control expressing plasmid. After 24 h, Luciferase signals were determined. FIG. 89B shows that HEK293T cells were transfected with plasmids expressing murine STING together with either E5R, M31R or pcDNA vector control expressing plasmid. After 24 h, Luciferase signal were determined.

FIG. 90A shows that HEK293T cells were transfected with Flag-cGAS and HA-ubiquitin. After 24 h, cells were infected with either WT VACV or VACVΔE5R. Cell lysis were collected after 6 h. cGAS was immunoprecipitated with anti-Flag antibody and ubiquitination was detected by anti-HA antibody. FIG. 90B shows Western blot analysis of cGAS and β-actin in whole cell lysates (WCL).

FIG. 91A is a scheme of tumor implantation and treatment for a B16-F10 unilateral tumor implantation model. Briefly, $5\times10^5$ B16-F10 melanoma cells were implanted intradermally to the right flank of C57B/6J mice. Eight days post tumor implantation, PBS, $4\times10^7$ pfu of MVA, MVAΔE5R or Heat-iMVA were intratumorally injected twice weekly. The tumor sizes were measured and the survival of mice was monitored. FIG. 91B is a graph of the Kaplan-Meier survival curve of tumor-bearing mice treated with either PBS, MVA, MVAΔE5R, or Heat-iMVA, treatments. (n=5, *P<0.05;  P<0.01; Mantel-Cox test). FIG. 91**C is a table showing median survival of mice treated with either PBS, MVA, MVAΔE5R, or Heat-iMVA.

FIGS. 92A-92C show schematic diagrams of generating MVAΔC7L-hFl3L-TK(−)-mOX40LAE5R virus. The first step involves the generation of MVAΔC7L-hFl3L through homologous recombination at the C8L and C6R loci, replacing C7L C7Lgene with hFl3L under the control of PsE/L promoter (FIG. 92A). The second step involves the generation of MVAΔC7L-hFlt3L-TK(−)-mOX40LC7LhFl3LmOX40Lthrough homologous recombination at the TK loci, replacing TK gene with mOX40L under the control of PsE/L promoter (FIG. 92B). The resulting virus was described in FIGS. 5A and 5B. The third step is to generate MVAΔC7L-hFl3L-TK(−)-mOX40LΔE5R through homologous recombination at the E4L and E6R loci, replacing E5R gene with mCherry under the control of P7.5 promoter (FIG. 92C). FIG. 92D shows RT-PCR results of IFNB gene expression in BMDCs infected with either MVAΔE5R, MVAΔC7L-hFl3L-TK(−)-mOX40L, or MVAΔC7L-hFl3L-TK(−)mOX40LΔE5R. WT and IFNAR$^{-/-}$ BMDCs were mock-infected or infected with MVAΔE5R, MVAΔC7L-hFl3L-TK(−)-mOX40L, or MVAΔC7L-hFl3L-TK(−)mOX40LΔE5R at a MOI of 10. Cells were collected at 16 h post infection and RT-PCR was performed. FIG. 92E shows ELISA results of IFN-β protein levels in the supernatants of BMDCs infected with either MVAΔE5R, MVAΔC7L-hFl3L-TK(−)-mOX40L, or MVAΔC7L-hFl3L-TK(−)mOX40LΔE5R. WT and IFNAR$^{-/-}$ BMDCs were mock-infected or infected with MVAΔE5R, MVAΔC7L-hFl3L-TK(−)-mOX40L, or MVAΔC7L-hFl3L-TK(−)mOX40LΔE5R at a MOI of 10. Supernatants were collected at 16 h post infection and ELISA was performed to measure IFN-β protein levels.

FIG. 93A shows the scheme of generating MVAΔC7LΔE5R-hFl3L-mOX40L. pUC57 plasmid is constructed to use the vaccinia viral synthetic early and late promoter (PsE/L) to express both human Flt3L and murine OX40L as a fusion protein in a single expression cassette. The coding sequence of human Flt3L and murine OX40L was separated by a cassette including a furin cleavage site followed by a 2A peptide (Pep2A) sequence. Recombinant virus expressing human Flt3L and murine OX40L fusion protein from E5R locus was generated through homologous recombination at E4L and E5R loci between pUC57 plasmid and MVAΔC7L C7Lviral genome. FIG. 93B shows the scheme of generating MVAΔC7L-OVA-ΔE5R-hFl3L-mOX40L. Recombinant virus expressing human Flt3L and murine OX40L fusion protein from E5R locus was generated through homologous recombination at E4L and E5R loci between pUC57 plasmid and MVAΔC7L-OVA viral genome.

FIG. 94A: Dual-luciferase assay of HEK293T cells transfected with ISRE-firefly luciferase reporter, a control plasmid pRL-TK that expresses Renilla luciferase, together with either myxoma M62R, Myxoma M62R-HA, Myxoma M64R, Myxoma M64R-HA, vaccinia C7L-expressing or control plasmid. 24 h post transfection, cells were treated with IFN-β for another 24 h before harvesting. FIG. 94B: Dual-luciferase assay of HEK293T cells transfected with IFNB-firefly luciferase reporter, a control plasmid pRL-TK that expresses Renilla luciferase, and STING-expressing plasmid, together with either myxoma M62R, Myxoma M62R-HA, Myxoma M64R, Myxoma M64R-HA, vaccinia C7L-expressing, or control plasmid. Cells were harvested at 24 h post transfection.

FIG. 96A shows the dot plots of FACS analysis of hFl3L expression on the Y axis and mOX40L expression on the X axis of BHK21 cells, murine melanoma cells B16-F10, or human melanoma cells SK-MEL28. Cells were infected with either MVA or MVAΔE5R-hFl3L-mOX40L at a MOI of 10 for 24 h. No virus mock infection control was included. FIG. 96B shows the graphs of medium fluorescence intensity (MFI) of human Flt3L and murine OX40L on infected BHK21, B16-F10, and SK-MEL28 cells infected with either MVA, MVAΔE5R-hFl3L-mOX40L, or PBS.

FIGS. 97-102 are a series of graphical representations of data showing that intratumoral injection of MVAΔE5R-hFl3L-mOX40L generated more activated tumor-infiltrating effector T cells in injected and non-injected distant tumors as well as in the spleens compared with MVA, MVAΔE5R, or Heat-iMVA in a B16-F10 bilateral tumor model. FIG. 97 shows the experimental scheme. Briefly, B16-F10 melanoma cells were implanted intradermally to the left and right flanks of C57B/6J mice ($5\times10^5$ to the right flank and $2.5\times10^5$ to the left flank). Seven days post tumor implantation, $2\times10^7$ pfu of either MVAΔE5R-hFl3L-mOX40L, MVA, MVAΔE5R, an equivalent amount of Heat-iMVA, or PBS was intratumorally (IT) injected into the larger tumors on the right flank twice, three days apart. Spleens were harvested at 2 days post second injection, ELISPOT analyses were performed to evaluate tumor-specific T cells in the spleens. Both injected and non-injected tumors were also isolated and tumor infiltrating lymphocytes were analyzed by FACS.

FIG. 98A shows the image of ELISPOT of triplicate samples from left to right. FIG. 98B shows the graph of IFN-$\gamma^+$ spots per 1,000,000 purified CD8$^+$ T cells. Each bar represents spleen sample from individual mouse (n=3-8) (*P<0.05; **P<0.01,/test).

FIG. 99A shows the representative dot plots of Granzyme B$^+$ CD8$^+$ T cells in non-injected tumors after treatment with either MVAΔE5R-hFl3L-mOX40L, Heat-iMVA, or PBS. FIG. 99B shows the graph of percentages of CD8$^+$ T cells out of CD3$^+$ cells. Data are means ±SEM (n=5-9). (P<0.01; *P<0.001,/test). FIG. 99C shows the graph of percentages of Granzyme B$^+$ CD8$^+$ T cells out of CD8$^+$ cells). Data are means ±SEM (n=5-9) (P<0.01; *P<0.001,/test).

FIG. 100A shows the representative dot plots of Granzyme B$^+$ CD4$^+$ T cells in non-injected tumors after treatment with either MVAΔE5R-hFl3L-mOX40L, Heat-iMVA, or PBS. FIG. 100B shows the graph of percentages of CD4$^+$ T cells out of CD3* cells. Data are means ±SEM (n=5-9). (*P<0.05;/test). FIG. 100C shows the graph of percentages of Granzyme $B^+$ $CD4^+$ T cells out of $CD4^+$ cells). Data are means ±SEM (n=5-9) (P<0.01; *P<0.001,/test).

FIG. 101A shows the representative dot plots of Granzyme B* $CD8^+$ T cells in the injected tumors after treatment with either MVAΔE5R-hFl3L-mOX40L, Heat-iMVA, or PBS. FIG. 101B shows the graph of percentages of $CD8^+$ T cells out of $CD3^+$ cells. Data are means ±SEM (n=5-9). ****P<0.0001,/test). FIG. 101C shows the graph of percentages of Granzyme $B^+$ $CD8^+$ T cells out of $CD8^+$ cells). Data are means ±SEM (n=5-9) (*P<0.05; ****P<0.0001,/test).

FIG. 102A shows the representative dot plots of Granzyme $B^+$ $CD4^+$ T cells in the injected tumors after treatment with either MVAΔE5R-hFl3L-mOX40L, Heat-iMVA, or PBS. FIG. 102B shows the graph of percentages of $CD4^+$ T cells out of $CD3^+$ cells. Data are means ±SEM (n=5-9). (**P<0.01;/test). FIG. 102C shows the graph of percentages of Granzyme $B^+$ $CD4^+$ T cells out of $CD4^+$ cells). Data are means ±SEM (n=5-9) (*P<0.05; P<0.01; **P<0.0001,/test).

FIGS. 103A-104C are a series of graphical representations of data showing that intratumoral injection of MVAΔE5R-hFl3L-mOX40L reduced $FoxP3^+CD4^+$ regulatory T cells in the injected tumors, but not in the non-injected tumors. FIG. 103A shows the representative dot plots of $FoxP3^+CD4^+$ cells in the injected tumors after treatment with either MVAΔE5R-hFl3L-mOX40L, Heat-iMVA, or PBS. FIG. 104C shows the graph of absolute numbers of $FoxP3^+CD4^+$T cells per gram of tumor. Data are means ±SEM (n=5-9).

FIGS. 105A to 109C are a series of graphical representations of data showing that intratumoral injection of MVAΔE5R-hFl3L-mOX40L preferentially reduces $OX40^+$ $FoxP3^+CD4^+$ regulatory T cells in the injected tumors. FIG. 105A shows the representative dot plots of $OX40^+FoxP3^+$ $CD4^+$ cells in the non-injected tumors after treatment with either MVAΔE5R-hFl3L-mOX40L, Heat-iMVA, or PBS.

FIG. 108 shows the representative dot plots of $OX40^+$ $CD8^+$ cells in the non-injected tumors after treatment with either MVAΔE5R-hFl3L-mOX40L, Heat-iMVA, or PBS.

FIGS. 109A-109C are a series of graphical representations of data showing that intratumoral injection of MVAΔE5R-hFl3L-mOX40L results in more reduction of $FoxP3^+CD4^+$ regulatory T cells in the injected tumors compared with MVAΔE5R. FIG. 109A shows the representative dot plots of $FoxP3^+CD4^+$ cells in the injected tumors after treatment with either MVAΔE5R-hFl3L-mOX40L, MVAΔE5R, or PBS. FIG. 109B shows the graph of percentages of $FoxP3^+CD4^+$ T cells out of $CD4^+$ cells in the injected tumors. Data are means ±SEM (n=5-9). (*P<0.05; P<0.01, 1 test). FIG. 109C shows the graph of absolute numbers of $FoxP3^+CD4^+$ T cells per gram of tumor. Data are means ±SEM (n=5-9). (P<0.01,/test).

FIGS. 110-115C are a series of graphical representations of data showing that intratumoral injection of MVAΔE5R-hFl3L-mOX40L generated more activated tumor-infiltrating effector $CD8^+$ and $CD4^+$ T cells in the injected and non-injected distant tumors in $OX40^{-/-}$ mice compared with WT mice in a B16-F10 bilateral murine melanoma model. FIG. 110 shows the experimental scheme. Briefly, B16-F10 melanoma cells were implanted intradermally to the left and right flanks of C57B/6J mice ($5\times10^5$ to the right flank and $2.5\times10^5$ to the left flank). Ten days post tumor implantation, intratumoral injections ($4\times10^7$ pfu) of either MVAΔE5R-hFl3L-mOX40L or PBS were performed to the larger tumors on the right flank twice, three days apart. Both the injected and non-injected distant tumors were harvested at 2 days post second injection and tumor-infiltrating lymphocytes were analyzed by FACS.

FIGS. 114A-115C demonstrate that IT injection of MVAΔE5R-hFl3L-mOX40L reduces $OX40^+FoxP3^+CD4^+$ and $OX40^+FoxP3^+CD4^+$ T cells in the injected tumors from the WT mice. FIG. 114A shows the representative dot plots of $OX40^+FoxP3^+CD4^+$ T cells in the injected tumors from WT and $OX40^{-/-}$ mice after treatment with either MVAΔE5R-hFl3L-mOX40L or PBS.

FIG. 115C shows the graph of absolute numbers of $OX40^+FoxP3^+CD4^+$ T cells per gram of tumor. Data are means ±SEM (n=4-10).

FIGS. 116A-119C are a series of graphical representations of data showing that intratumoral injection of MVAΔE5R-hFl3L-mOX40L results in more proliferation and activation of tumor-infiltrating effector $CD8^+$ and $CD4^+$ T cells in distant non-injected tumors from $OX40^{-/-}$ mice compared with WT mice. FIG. 116A shows the representative dot plots of Granzyme $B^+$ $CD8^+$ T cells in non-injected tumors from WT and $OX40^{-/-}$ mice after treatment with either MVAΔE5R-hFl3L-mOX40L or PBS.

FIG. 117A shows the representative dot plots of $Ki67^+$ $CD8^+$ T cells in non-injected tumors from WT and $OX40^{-/-}$ mice after treatment with either MVAΔE5R-hFl3L-mOX40L or PBS. FIG. 117B shows the graph of percentages of $Ki67^+CD8^+$ T cells out of $CD8^+$ cells. Data are means ±SEM (n=5-10). FIG. 117C shows the graph of absolute numbers of $Ki67^+CD8^+$ T cells per gram of tumor. Data are means ±SEM (n=5-10).

FIG. 119C shows the graph of absolute numbers of $Ki67^+CD4^+$ T cells per gram of tumor. Data are means ±SEM (n=5-10).

Figure 120:
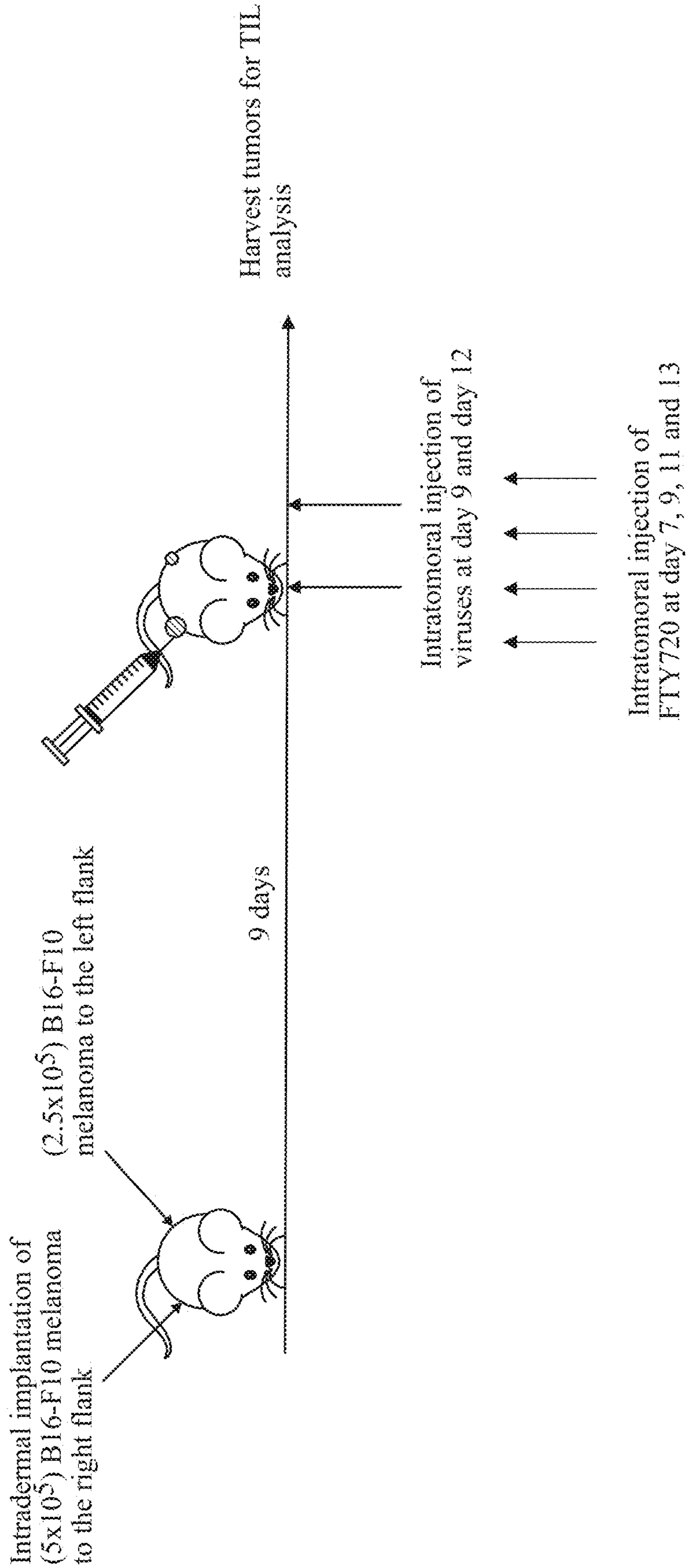

FIGS. 120-124B are a series of graphical representations of data showing that intratumoral injection of MVAΔE5R-hFl3L-mOX40L was capable of inducing antitumor effects without recruiting T cells from the lymphoid organs. FIG. 120 shows the experimental scheme. Briefly, B16-F10 melanoma cells were implanted intradermally to the left and right flanks of C57B/6J mice ($5\times10^5$ to the right flank and $2.5\times10^5$ to the left flank). Nine days post tumor implantation, intratumoral injections ($4\times10^7$ pfu) of either MVAAE5R-hFl3L-mOX40L, or PBS were performed to the larger tumors on the right flank twice on day 9 and 12. The injected tumors were harvested at 2 days post second injection and tumor-infiltrating lymphocytes were analyzed by FACS. FTY720 (25 μg), which blocks egress of lymphocytes from the lymphoid organs, was given to the mice intrapertoneally on day 7, 9, 11, and 13.

Figure 121:
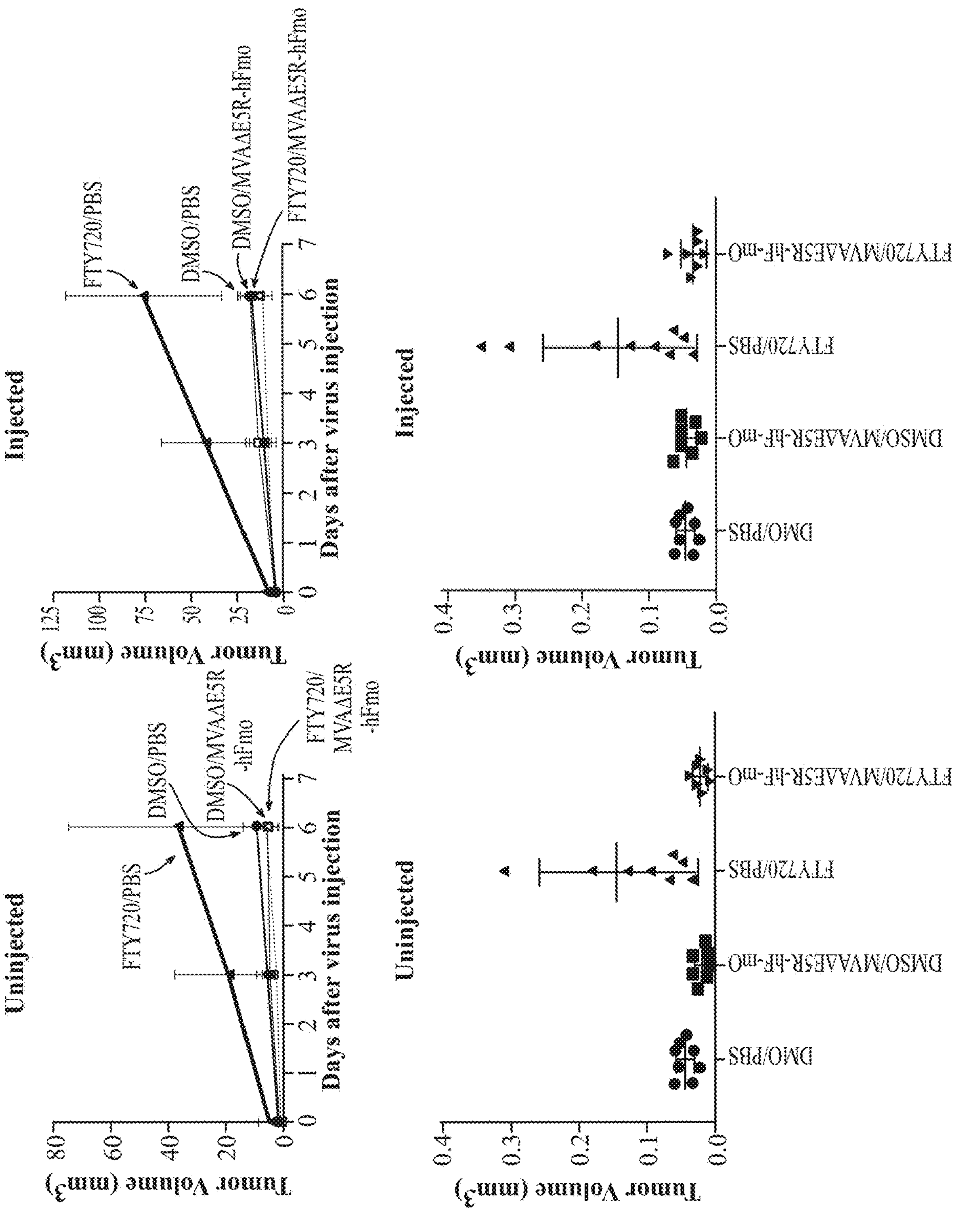

FIG. 121 (upper panel) shows the graphs of tumor volumes of both injected and non-injected tumors over time. Data are means +SEM (n=7-8). FIG. 121 (lower panel) shows the graphs of tumor volumes of both injected and non-injected tumors at day 6 post first injection. Data are means +SEM (n=7-8).

Figure 122A:
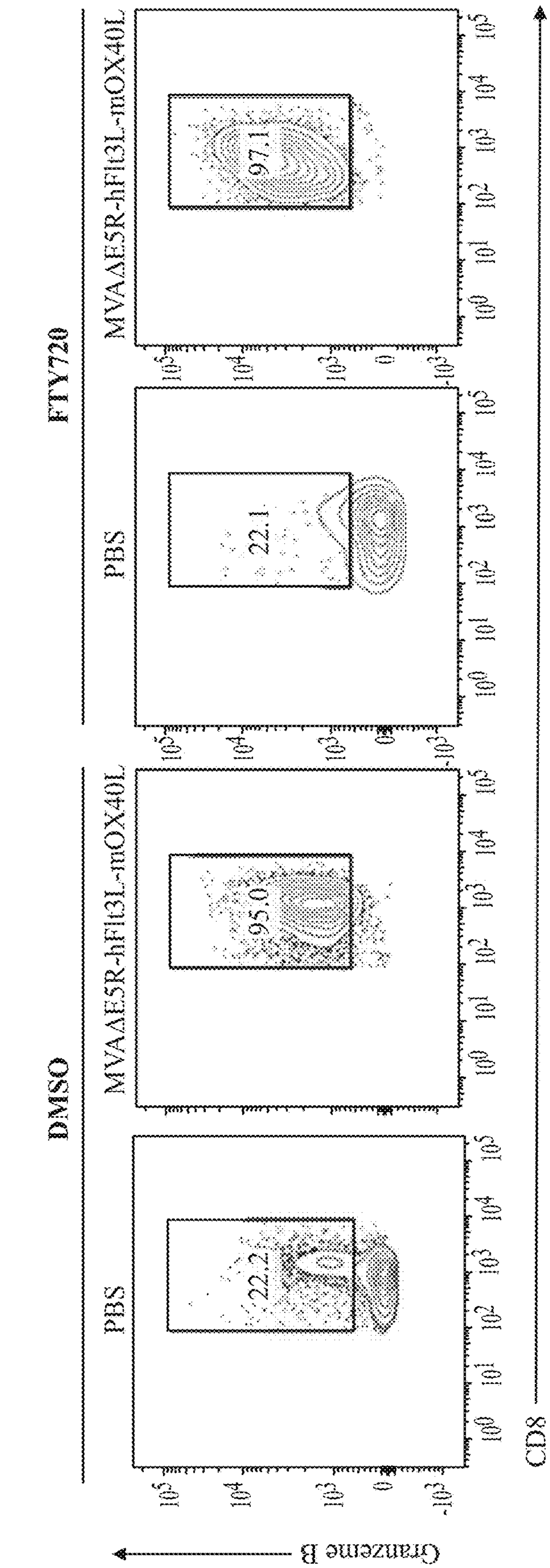
Figure 122B:
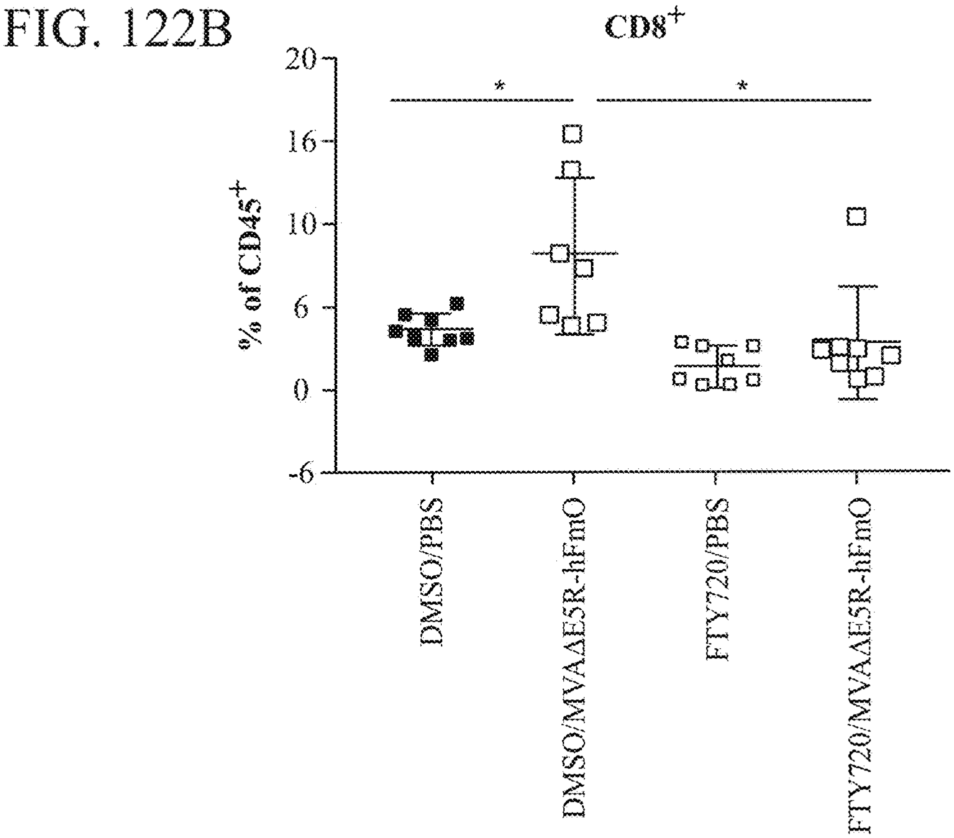
Figure 122C:
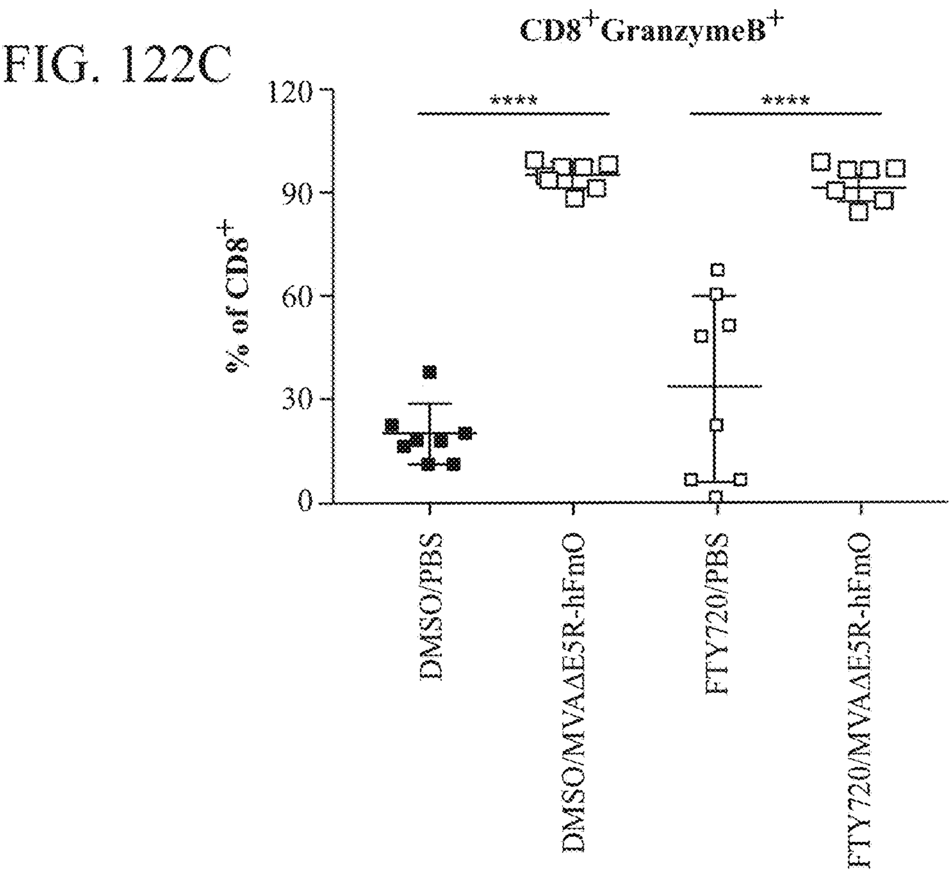
Figure 122D:
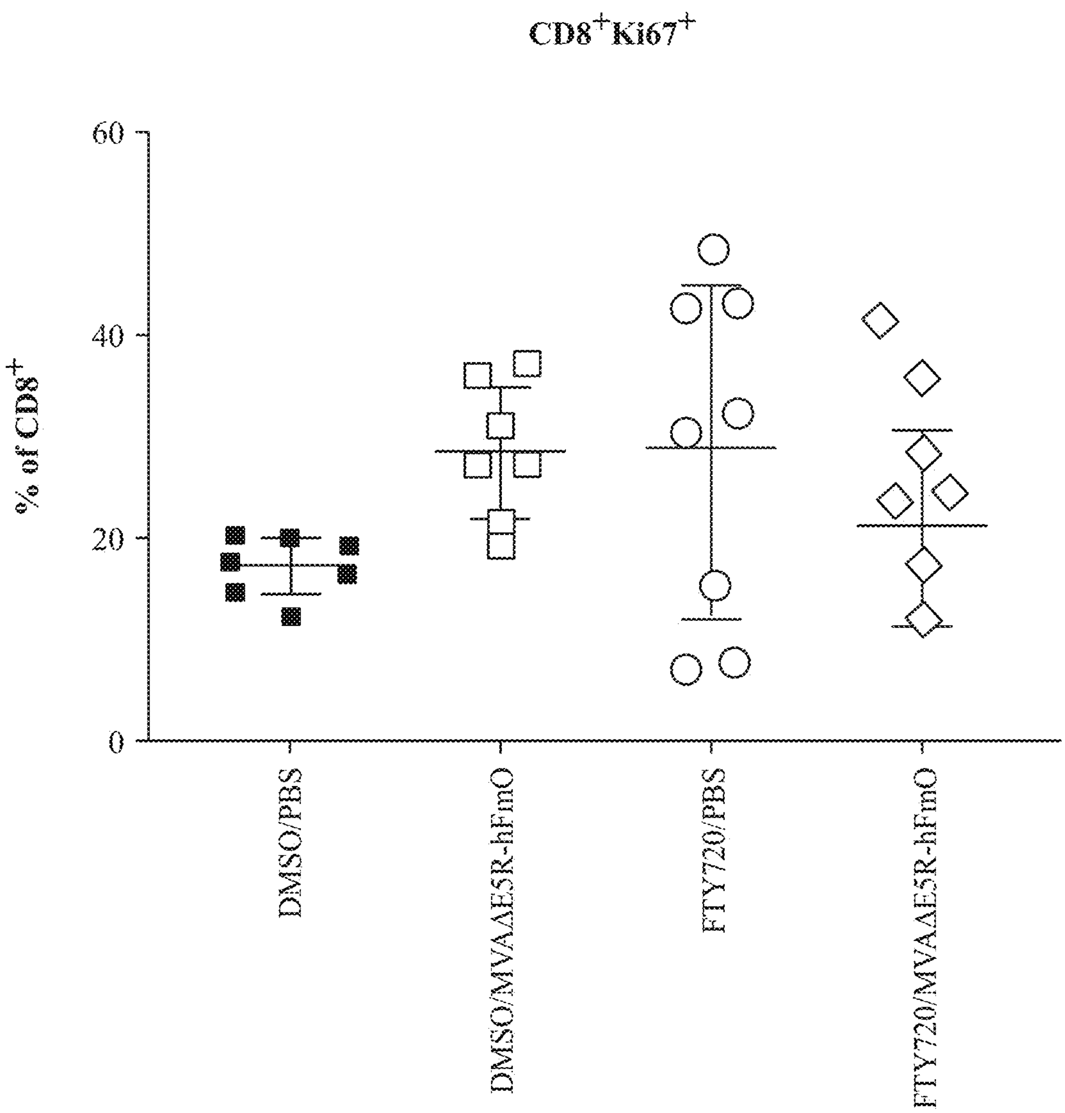

FIGS. 122A-122D shows the representative dot plots of Granzyme $B^+$ $CD8^+$ T cells in injected tumors from mice after treatment with either MVAΔE5R-hFl3L-mOX40L or PBS in combination with intraperitoneal delivery of FTY720 or DMSO. FIG. 122B shows the graph of percentages of $CD8^+$ T cells out of $CD45^+$ cells. Data are means ±SEM (n=7-8). FIG. 122C shows the graph of percentages of Granzyme $B^+CD8^+$ T cells out of $CD8^+$ cells. Data are means ±SEM (n=7-8). FIG. 122D shows the graph of percentages of $Ki67^+CD8^+$T cells out of $CD8^+$ cells. Data are means ±SEM (n=7-8).

Figure 123A:
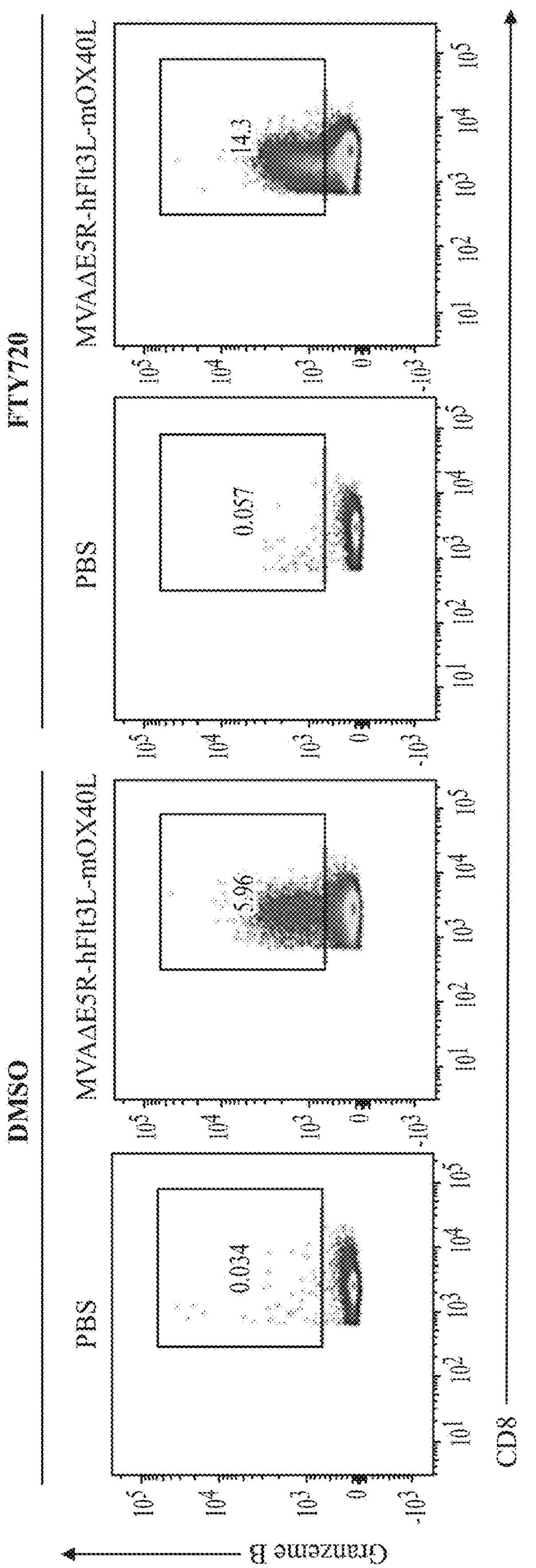
Figure 123B:
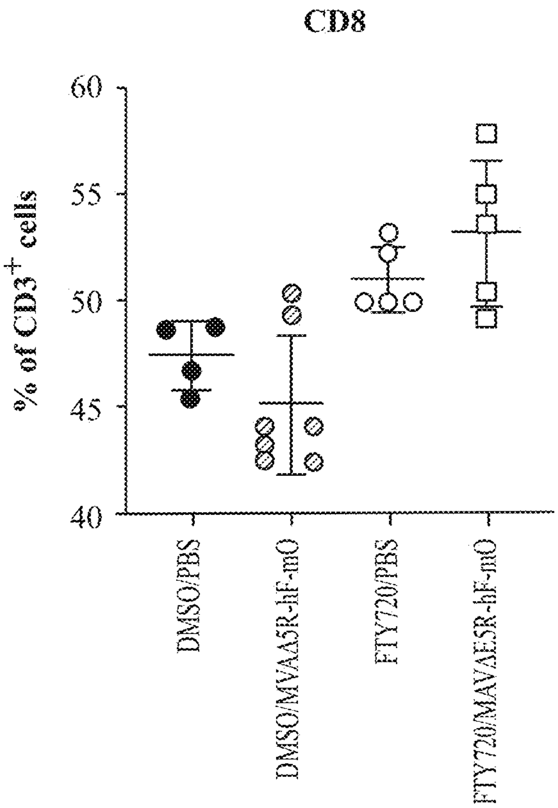
Figure 123C:
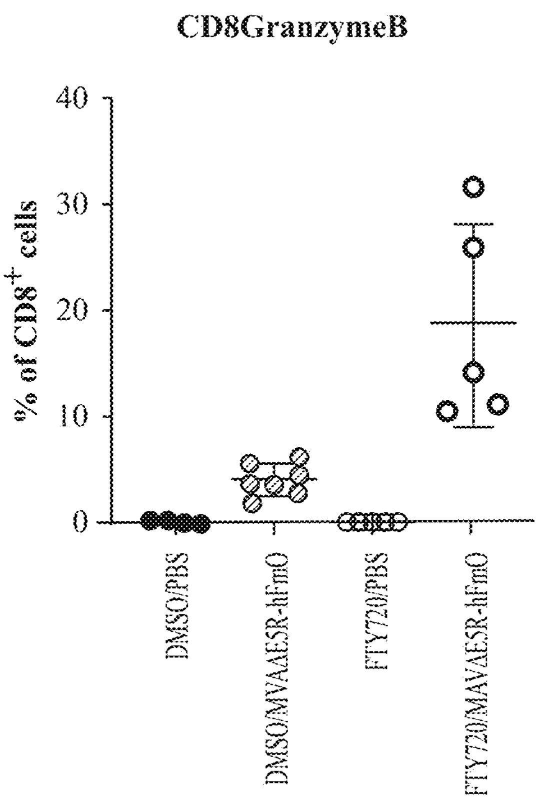

FIG. 123A shows the representative dot plots of Granzyme $B^+$ $CD8^+$ T cells in TDLNs of the injected tumors from mice after treatment with either MVAΔE5R-hFl3L-mOX40L or PBS in combination with intraperitoneal delivery of FTY720 or DMSO. FIG. 123B shows the graph of percentages of $CD8^+$ T cells out of $CD3^+$ cells. Data are means ±SEM (n=7-8). FIG. 123C shows the graph of percentages of Granzyme $B^+CD8^+$ T cells out of $CD8^+$ cells. Data are means ±SEM (n=7-8).

Figure 124A:
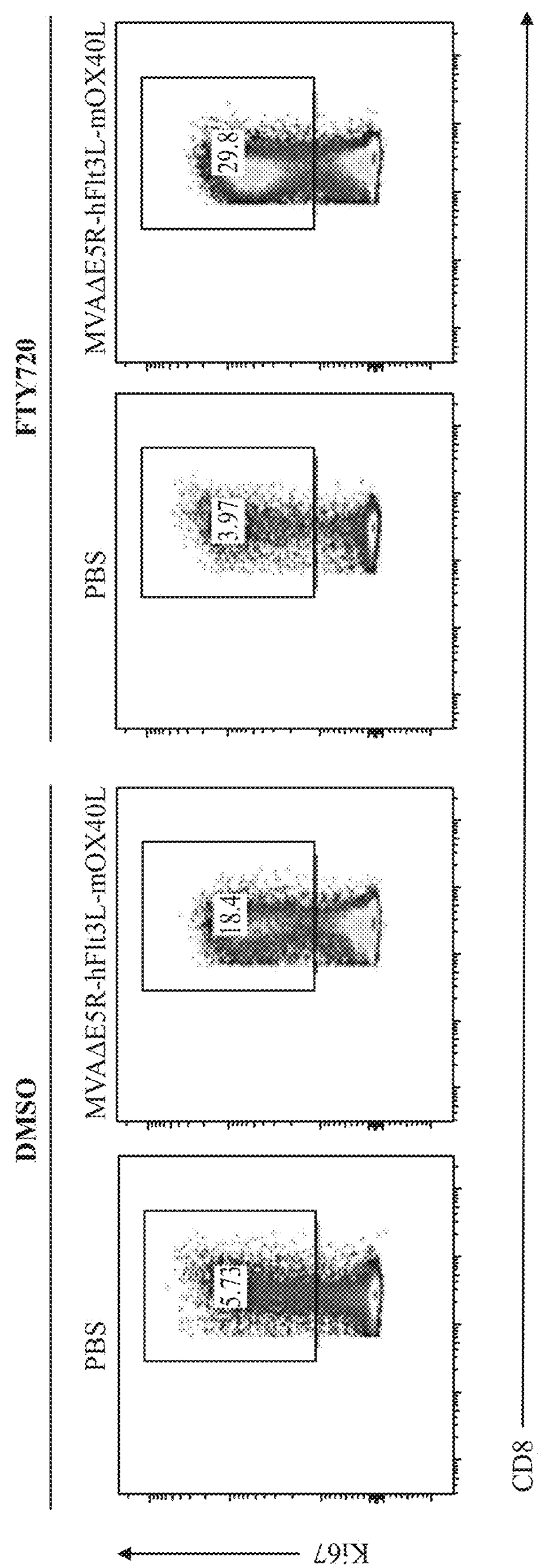
Figure 124B:
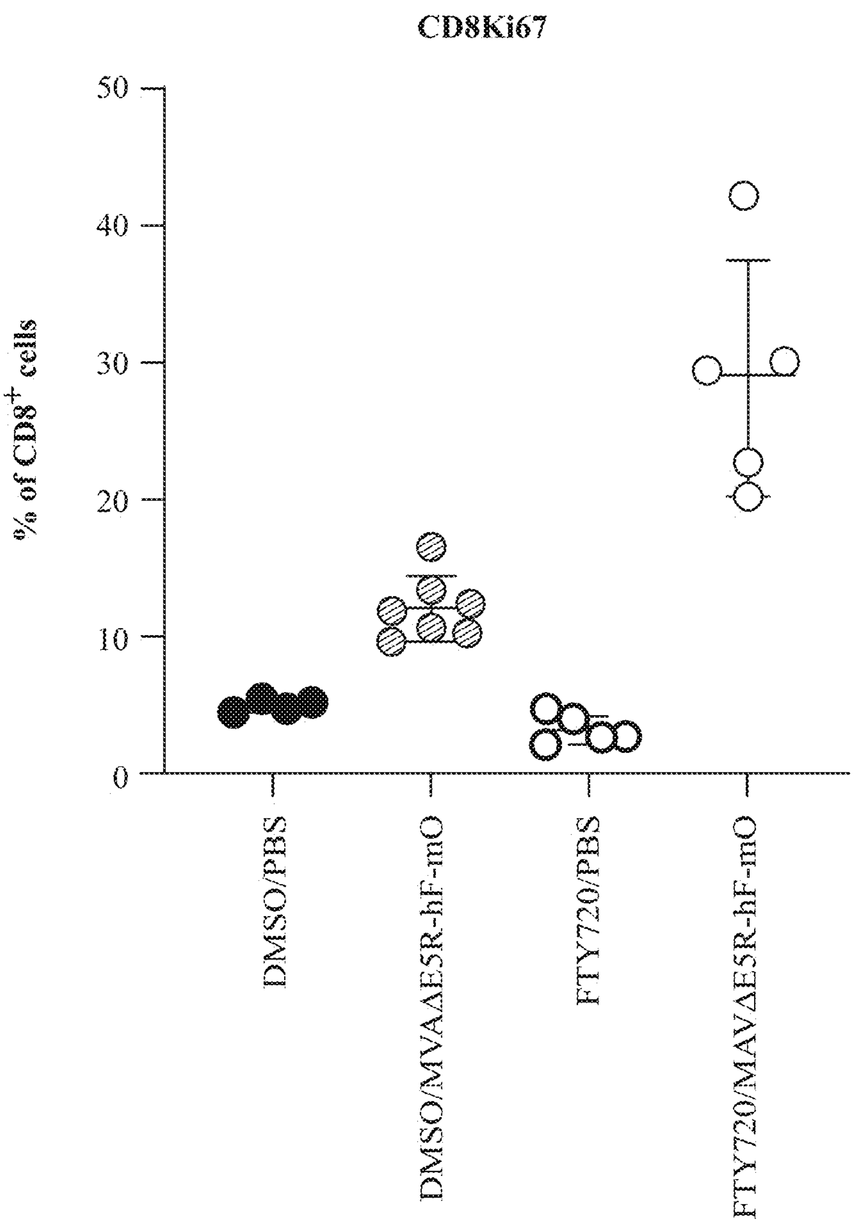

FIG. 124A shows the representative dot plots of $Ki67^+$ $CD8^+$ T cells in TDLNs of the injected tumors from mice after treatment with either MVAΔE5R-hFl3L-mOX40L or PBS in combination with intraperitoneal delivery of FTY720 or DMSO. FIG. 124B shows the graph of percentages of $Ki67^+CD8^+$ T cells out of $CD8^+$ cells. Data are means ±SEM (n=7-8).

Figure 125:
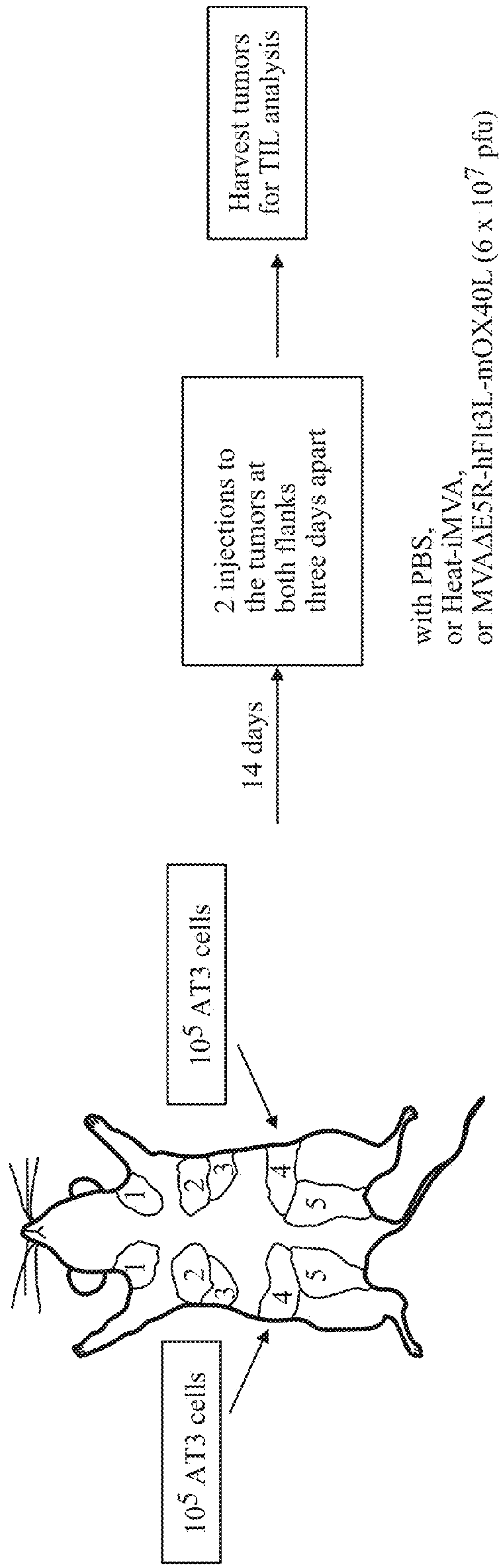

FIGS. 125-129C are graphical representations of data showing intratumoral delivery of MVAΔE5R-hFl3L-mOX40L delays tumor growth, activates $CD8^+$ T cells and reduces $FoxP3^+CD4^+$ T cells in the injected tumors in a murine AT3 breast cancer fat pad implantation model. FIG. 125 is a scheme of tumor implantation and treatment for murine breast cancer AT3 fat pad implantation model. Briefly, AT3 cells ($1\times10^6$) were implanted into the 4th fat pad of the C57B/6J mice. 14 days post tumor implantation, intratumoral injections ($6\times10^7$ pfu) of MVAΔE5R-hFl3L-mOX40L, or Heat-iMVA, or PBS, were performed twice, three days apart. The injected tumors were measured and harvested for FACS analysis.

Figure 126A:
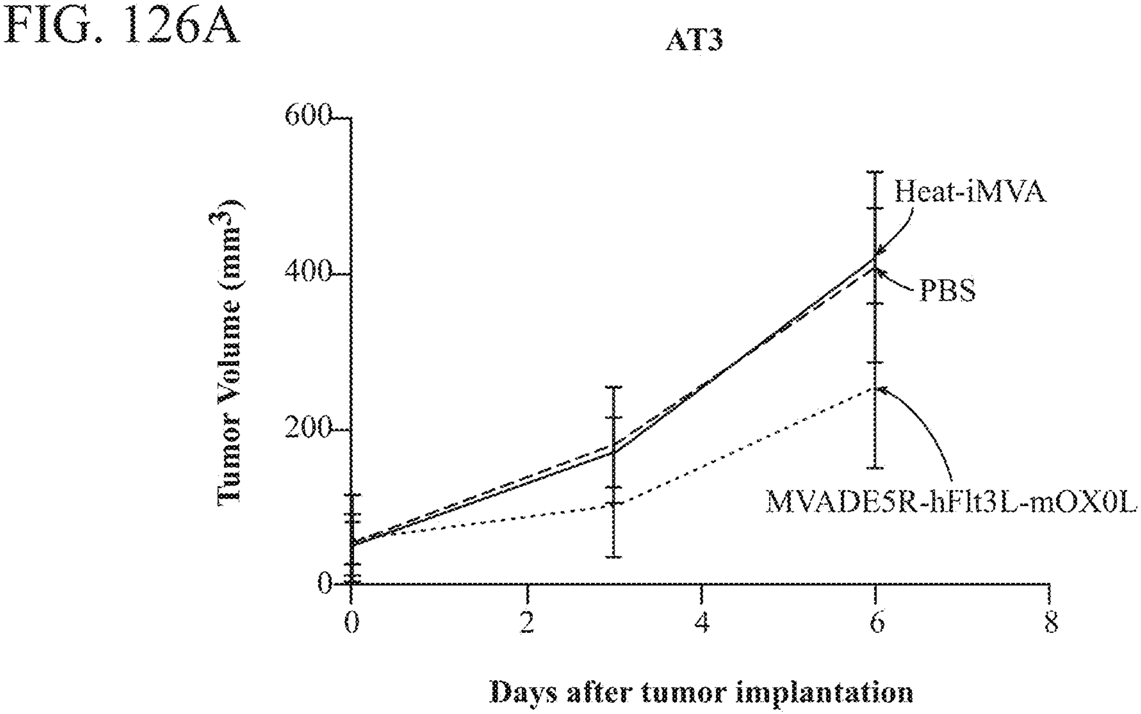
Figure 126B:
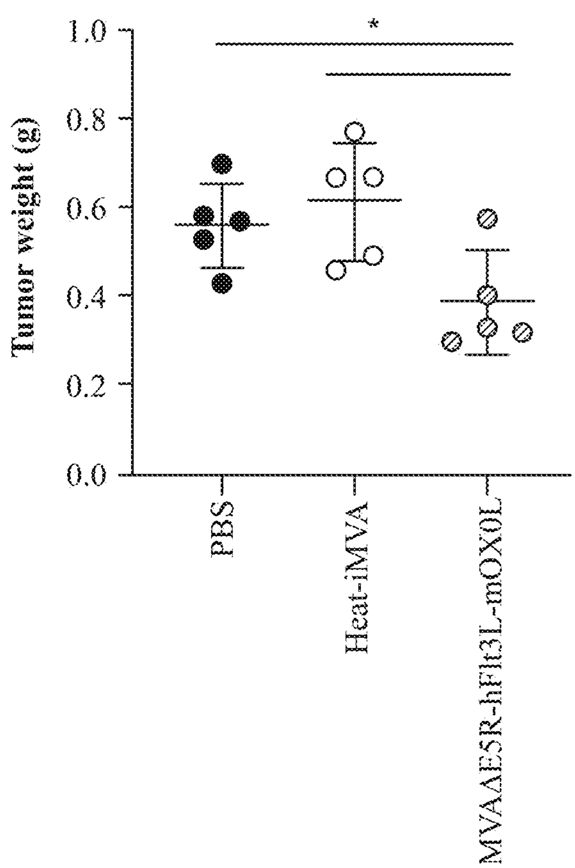

FIG. 126A shows the graph of tumor volumes of injected AT3 tumors after treatment with MVAΔE5R-hFl3L-mOX40L, or Heat-iMVA, or PBS over time. Data are means ±SEM (n=5). Graph of tumor weight of injected tumors at day 6 post first injection. Data are means ±SEM (n=5). FIG. 126B shows the tumor weighs on day 6. *=$p<0.05$.

Figure 127A:
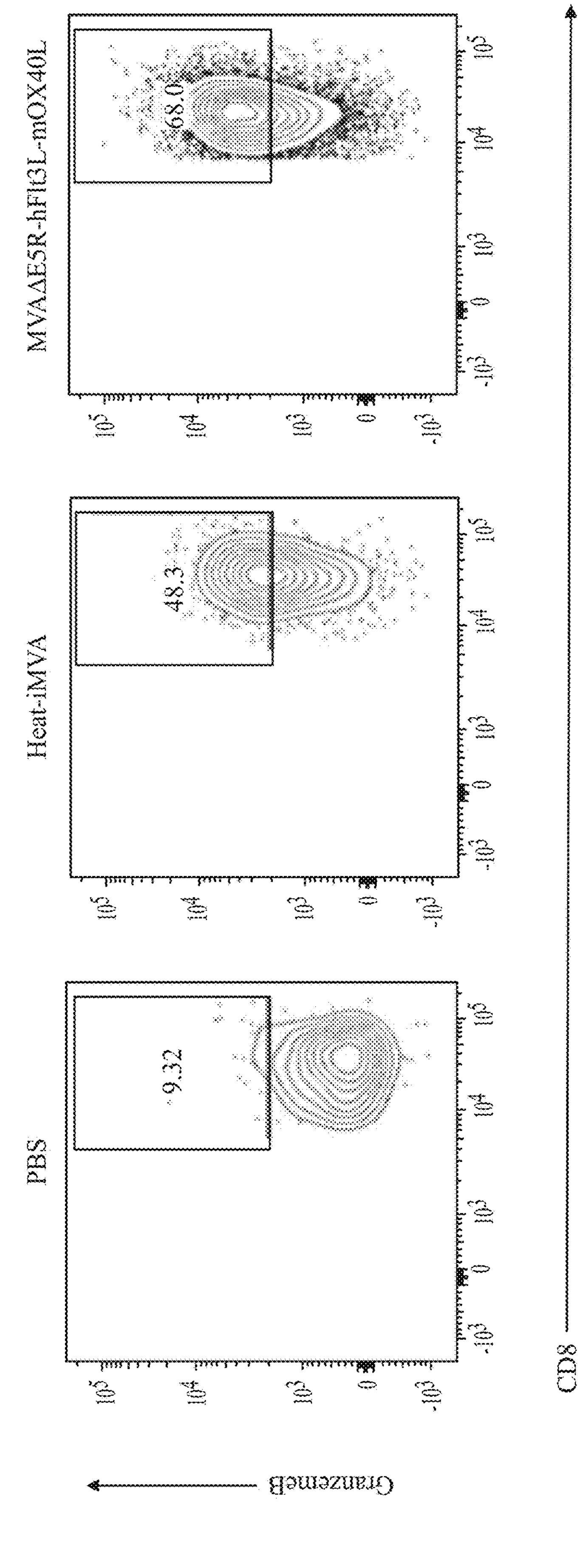
Figure 127B:
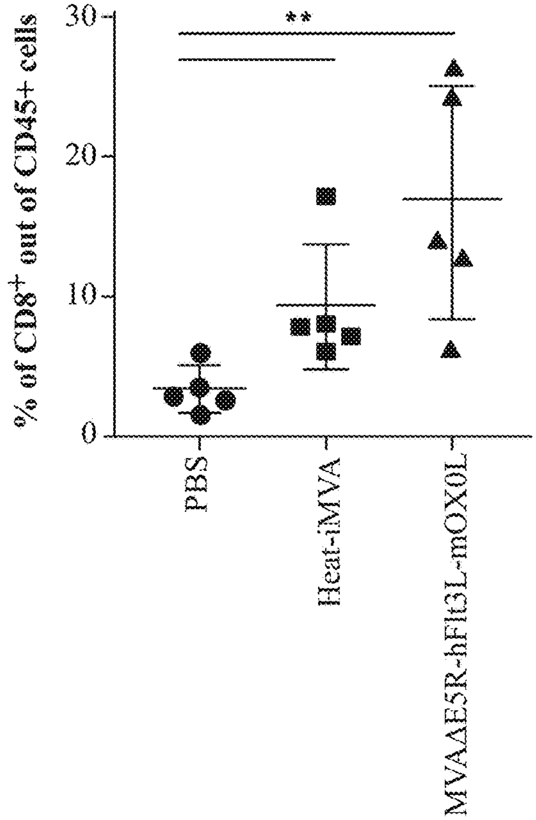
Figure 127C:
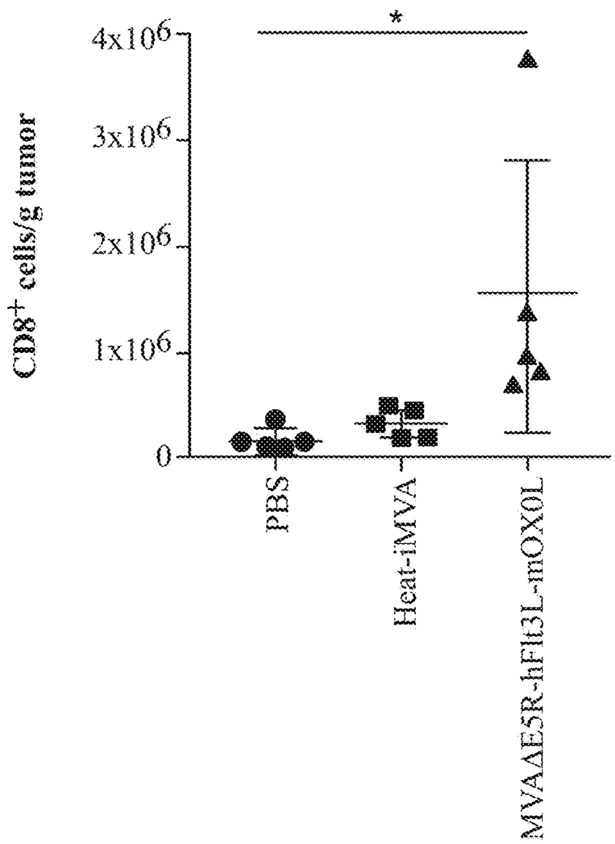
Figure 127D:
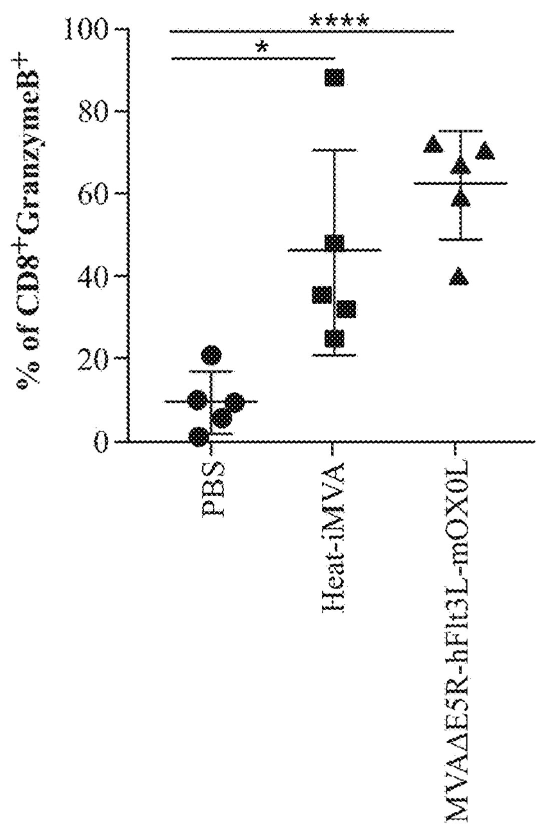
Figure 127E:
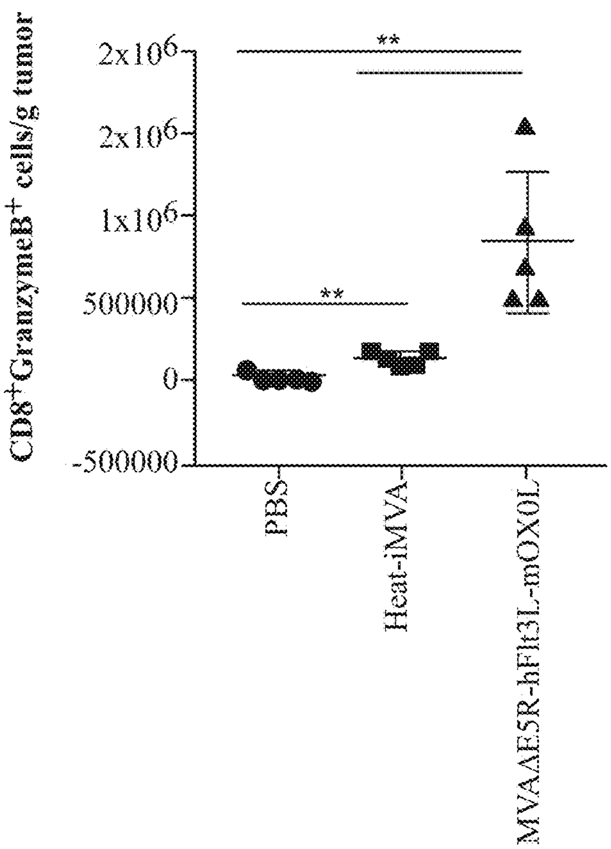

FIG. 127A shows the representative dot plots of Granzyme $B^+$ $CD8^+$ T cells in injected AT3 tumors after treatment with either MVAΔE5R-hFl3L-mOX40L, or Heat-iMVA, or PBS. FIG. 127B shows the graph of percentages of $CD8^+$ T cells out of $CD3^+$ cells. Data are means ±SEM (n=5). FIG. 127C shows the graph of absolute numbers of $CD8^+$ T cells per gram of tumor. Data are means ±SEM (n=5). FIG. 127D shows the graph of percentages of Granzyme $B^+$ $CD8^+$ T cells out of $CD8^+$ cells. Data are means ±SEM (n=5). FIG. 127E shows the graph of absolute numbers of Granzyme $B^+$ $CD8^+$ T cells per gram of tumor. Data are means ±SEM (n=5).

Figure 128A:
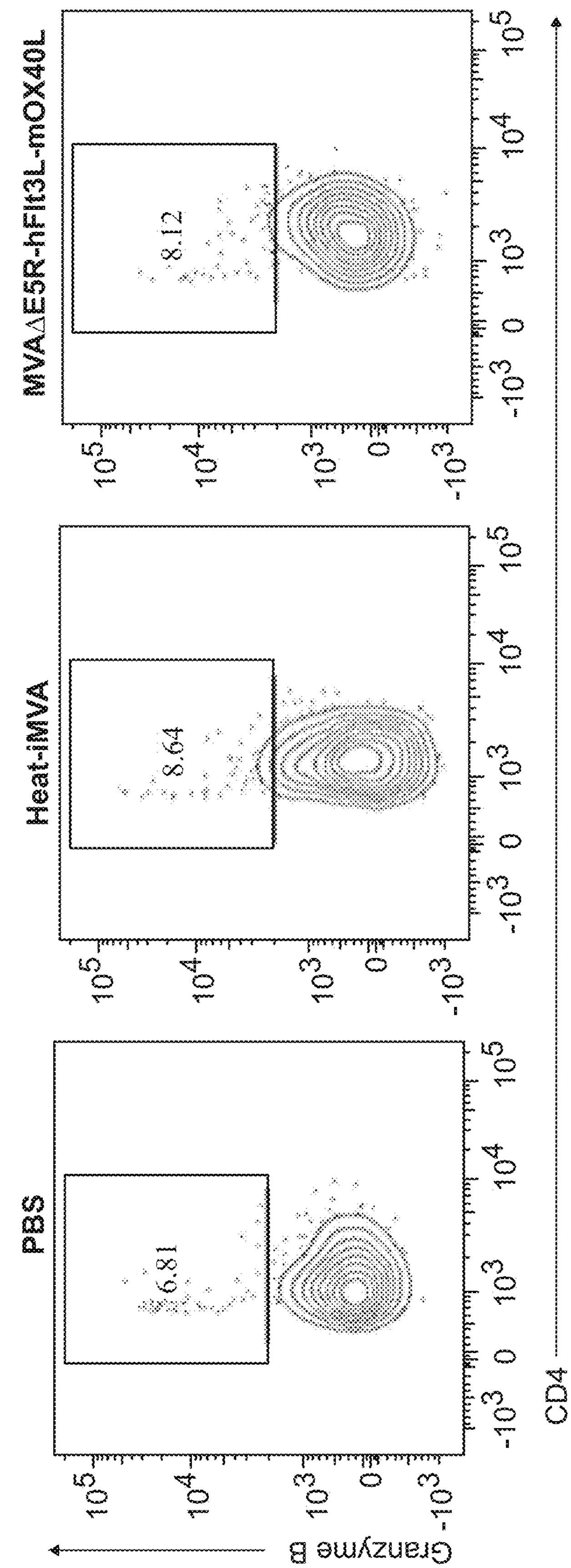
Figure 128B:
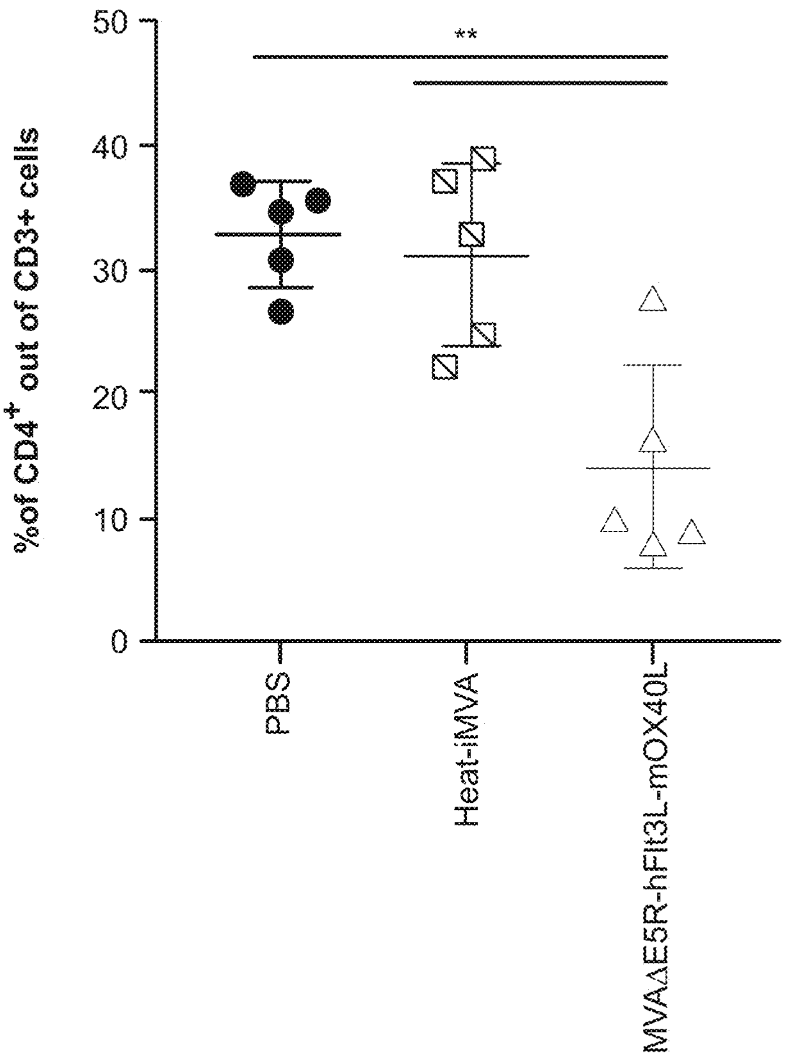
Figure 128C:
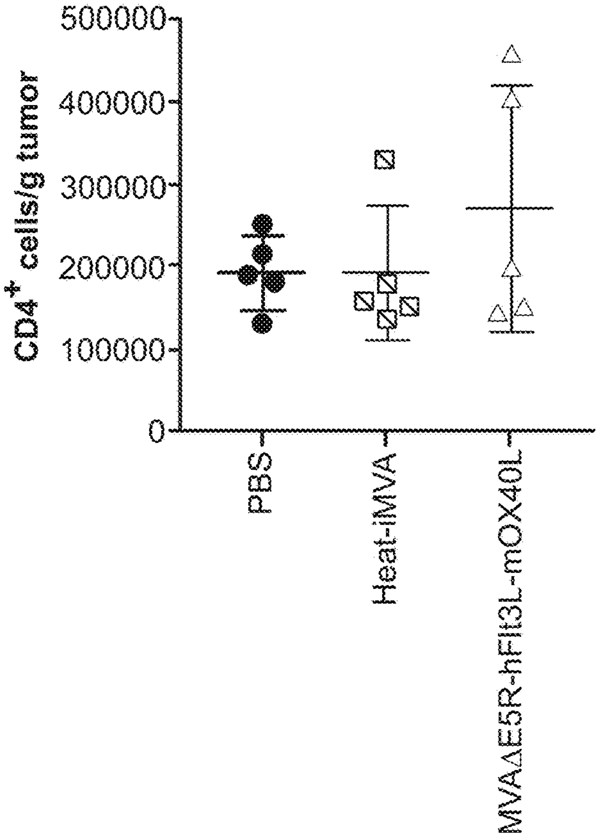
Figure 128D:
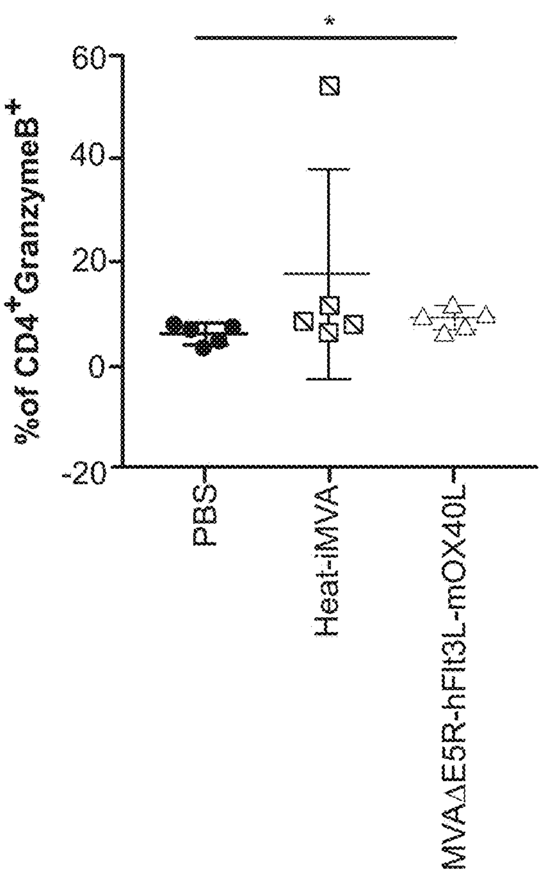
Figure 128E:
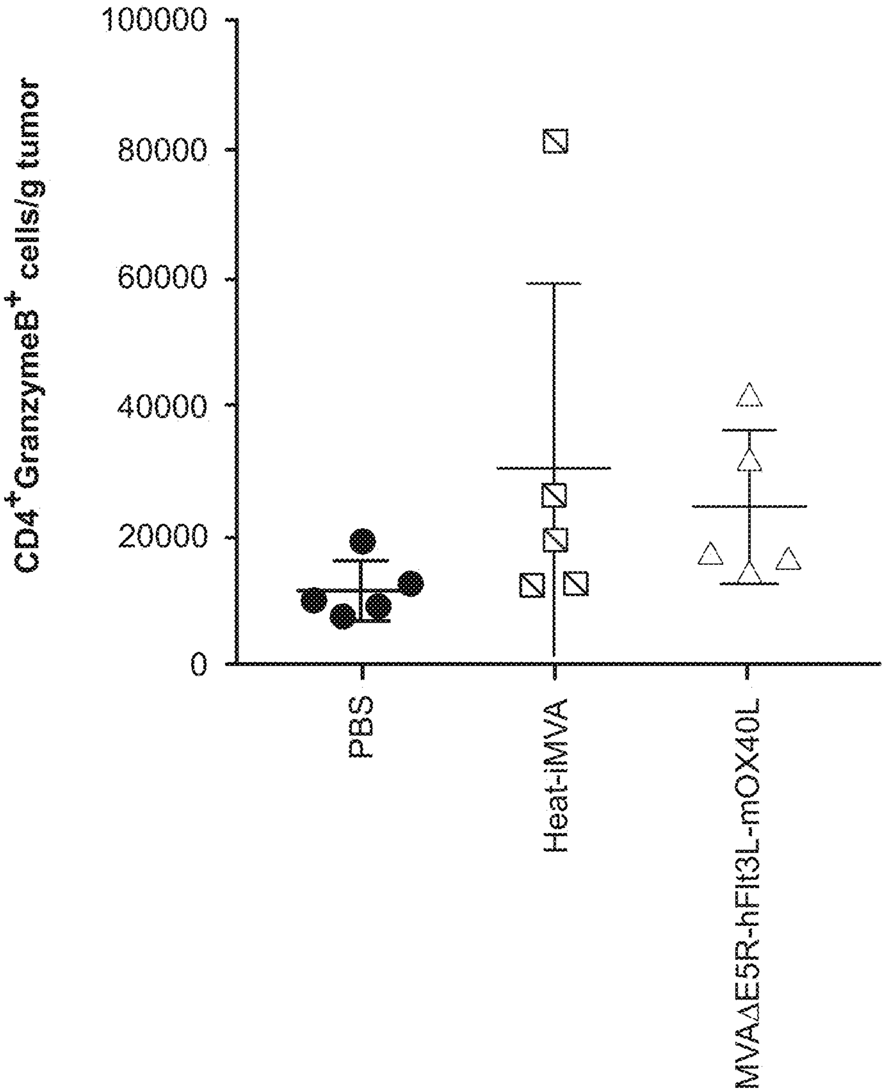

FIG. 128A shows the representative dot plots of Granzyme $B^+$ $CD4^+$ T cells in injected AT3 tumors after treatment with either MVAΔE5R-hFl3L-mOX40L, or Heat-iMVA, or PBS. FIG. 128B shows the graph of percentages of $CD4^+$ T cells out of $CD3^+$ cells. Data are means ±SEM (n=5). FIG. 128C shows the graph of absolute numbers of $CD4^+$ T cells per gram of tumor. Data are means ±SEM (n=5). FIG. 128D shows the graph of percentages of Granzyme $B^+$ $CD4^+$ T cells out of $CD4^+$ cells. Data are means ±SEM (n=5). FIG. 128E shows the graph of absolute numbers of Granzyme $B^+$ $CD4^+$ T cells per gram of tumor. Data are means ±SEM (n=5).

Figure 129A:
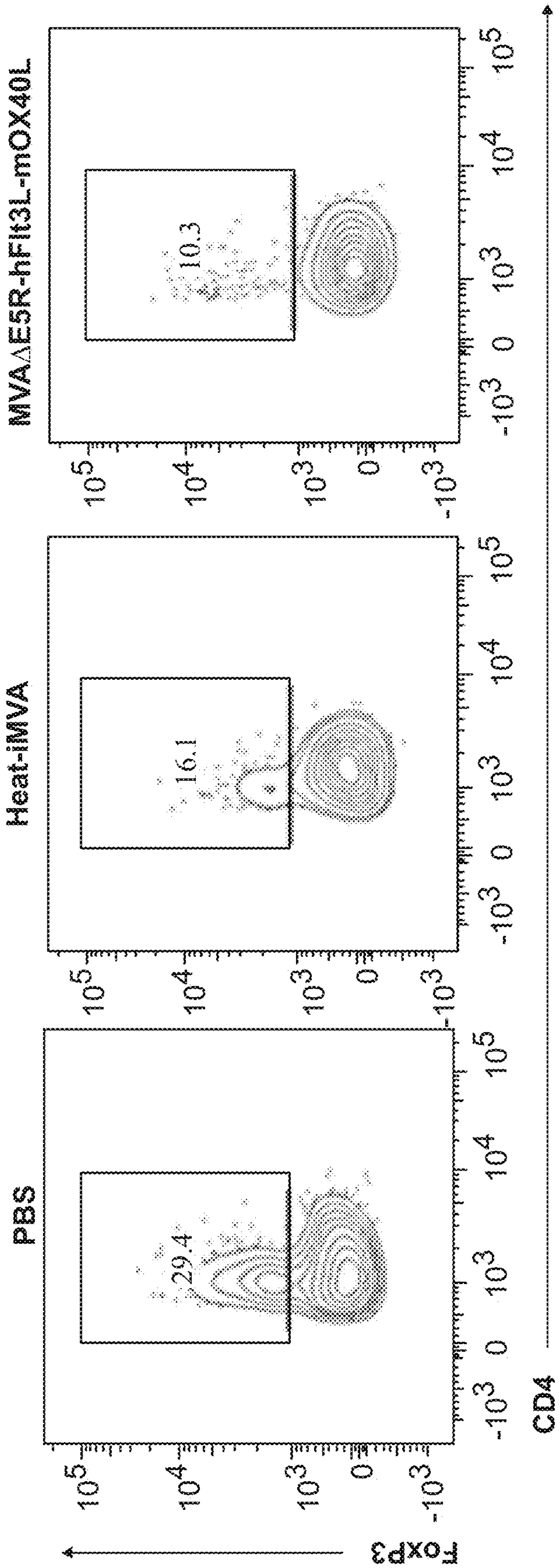
Figure 129B:
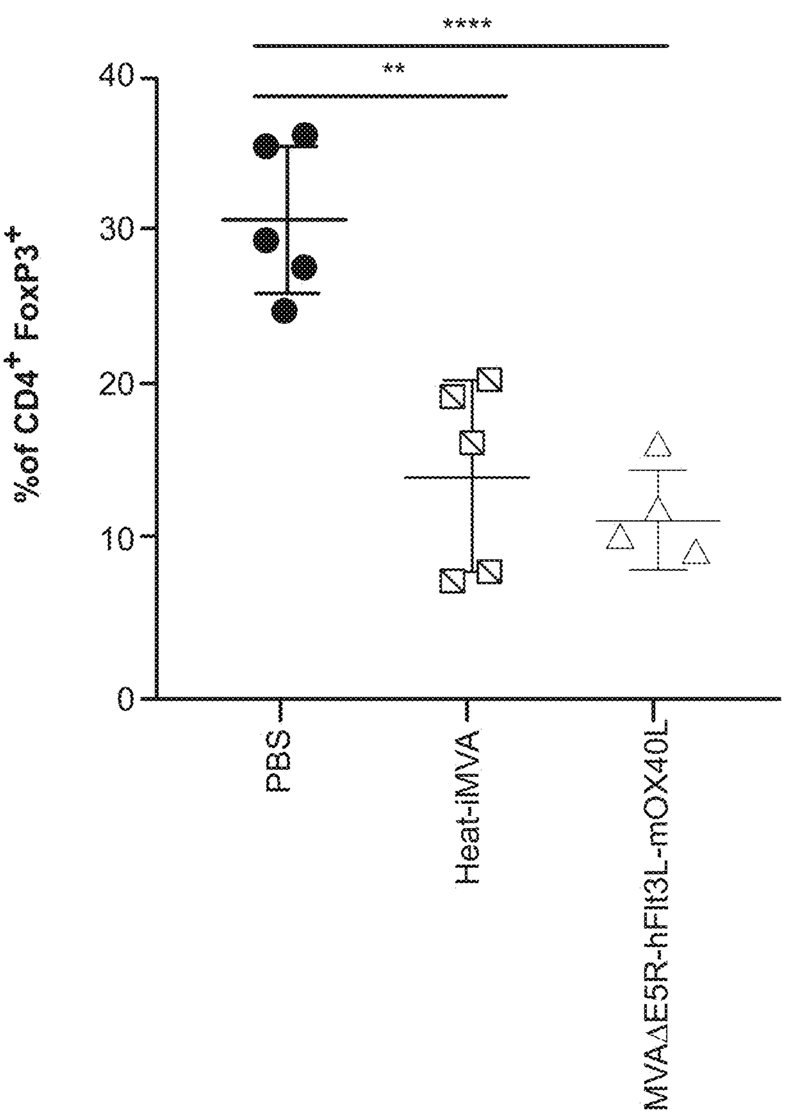
Figure 129C:
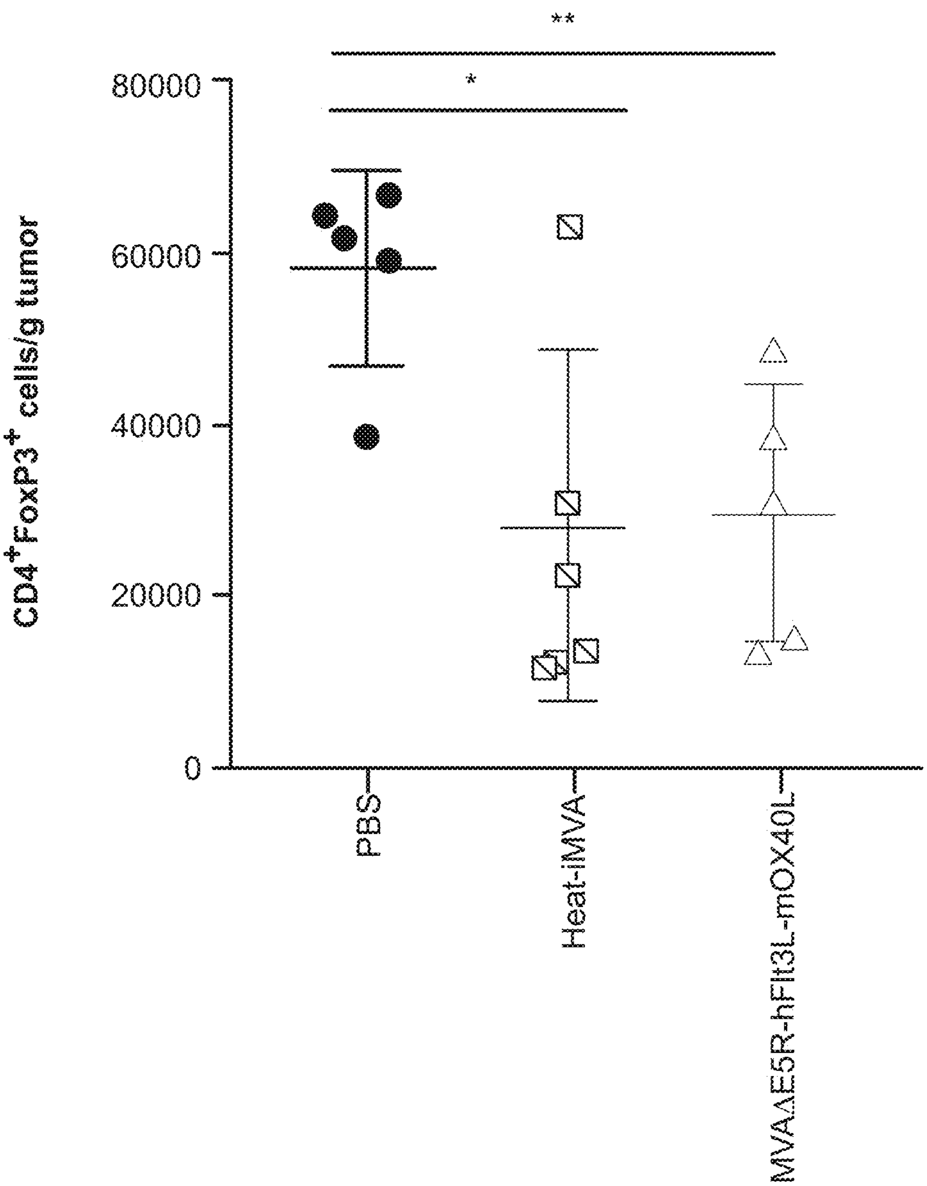

FIG. 129A shows the representative dot plots of $FoxP3^+$ $CD4^+$ T cells in injected AT3 tumors after treatment with either MVAΔE5R-hFl3L-mOX40L, or Heat-iMVA, or PBS. FIG. 129B shows the graph of percentages of $FoxP3^+CD4^+$ T cells out of $CD4^+$ cells. Data are means ±SEM (n=5). FIG. 129C shows the graph of absolute numbers of $FoxP3^+CD4^+$ T cells per gram of tumor. Data are means ±SEM (n=5).

Figure 130:
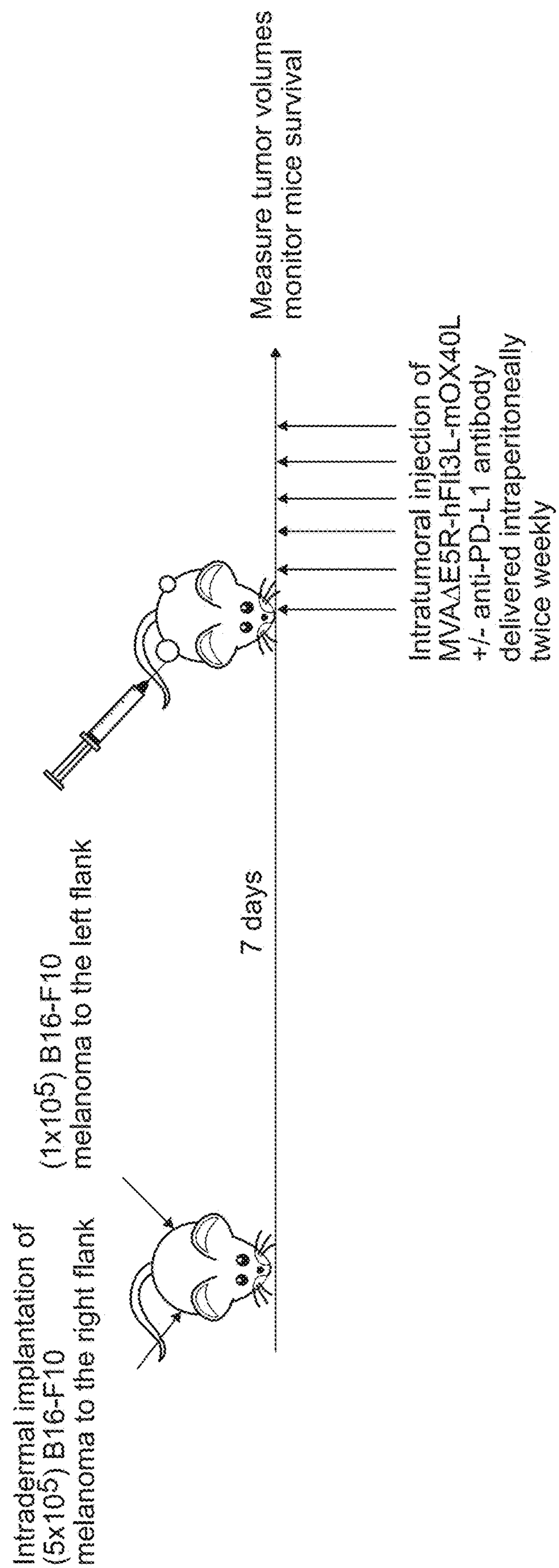
Figure 131A:
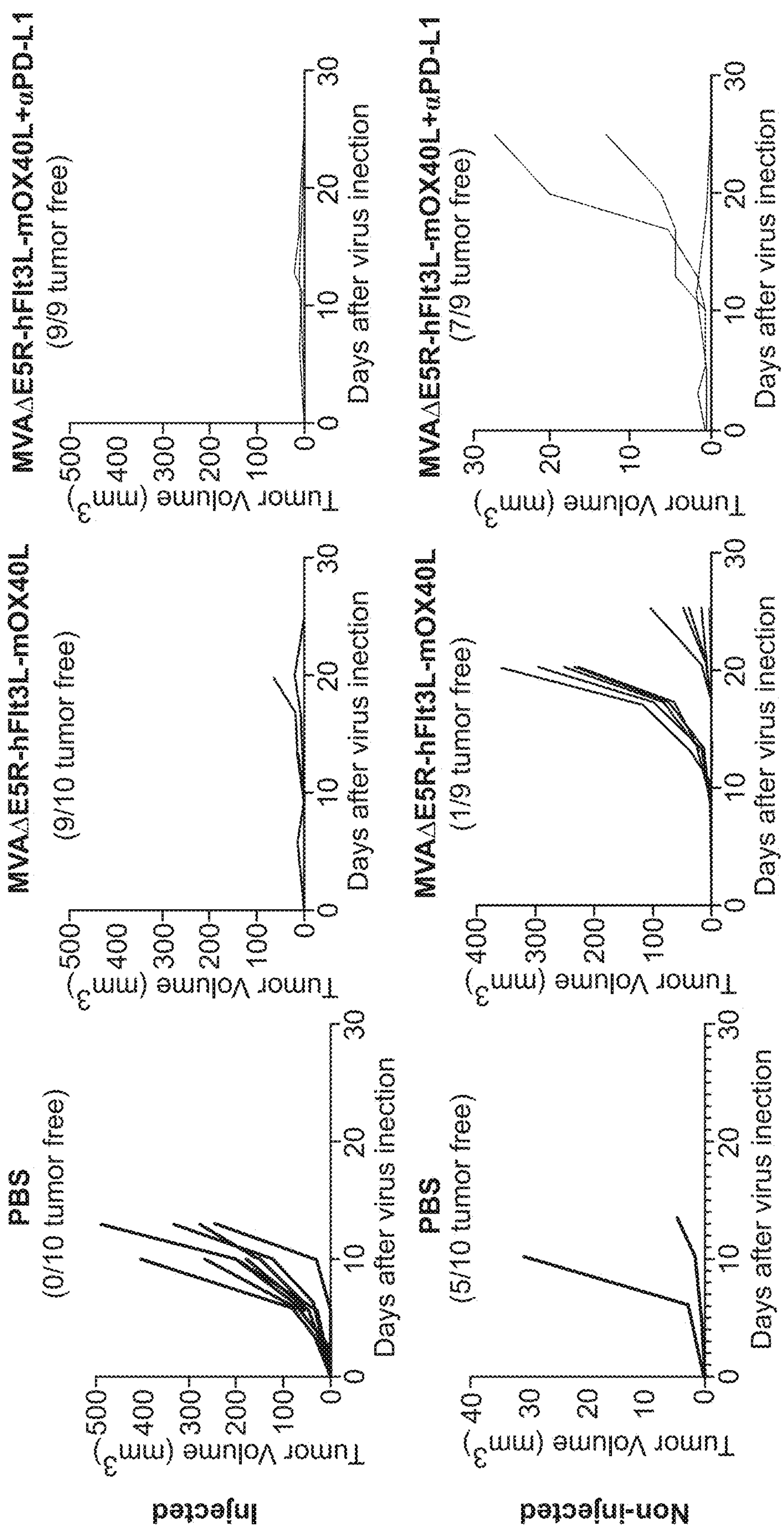
Figure 131B:
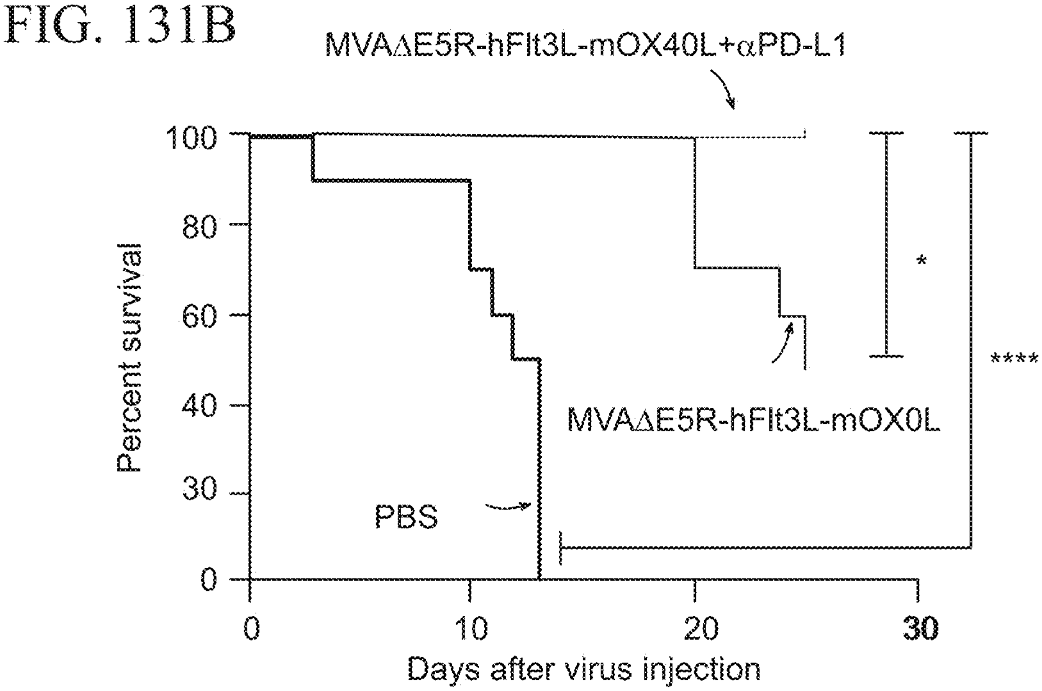

FIGS. 130-131B are graphical representations of data showing that combination of IT delivery of MVAΔE5R-hFl3L-mOX40L and intraperitoneal delivery of anti-PD-L1 results in enhanced therapeutic efficacy in a bilateral B16-F10 melanoma implantation model.

FIG. 130 shows the experimental scheme. Briefly, B16-F10 melanoma cells were implanted intradermally to the left and right flanks of C57B/6J mice ($5\times10^5$ to the right flank and $1\times10^5$ to the left flank). Seven days post tumor implantation, $4\times10^7$ pfu of either MVAΔE5R-hFl3L-mOX40L or PBS was intratumorally (IT) injected into the larger tumors on the right flank twice per week. One group of the mice also received anti-PD-L1 antibody (250 μg) twice a week in conjunction with IT MVAΔE5R-hFl3L-mOX40L. Tumor volumes and mice survival were monitored.

FIG. 131A shows tumor volumes of both injected and non-injected tumors in mice treated with either PBS or MVAΔE5R-hFl3L-mOX40L intratumorally, or with the combination of IT MVAΔE5R-hFl3L-mOX40L plus IP anti-PD-L1. FIG. 131B shows the Kaplan Meier survival curve of the three groups.

FIGS. 132A-134B are graphical representations of data showing MVAΔE5R-hFlt3L-hOX40LhOX40L infection of BMDCs induces IFNB gene expression and IFN-β protein secretion; infection of human tumors (extramammary Paget's disease) with MVAΔE5R-hFlt3L-hOX40LhOX40L ex vivo results in the increase of Granzyme $B^+$ $CD8^+$ T cells and the reduction of $FoxP3^+CD4^+$ T cells.

Figure 132A:
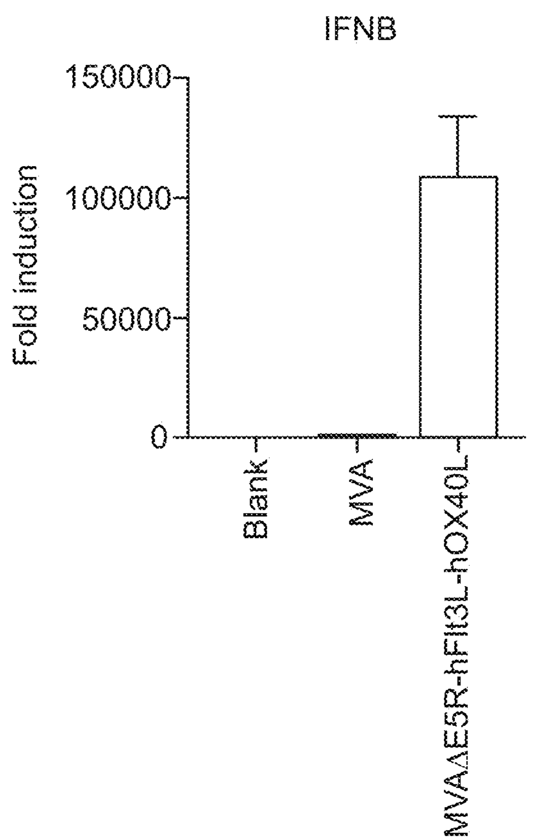
Figure 132B:
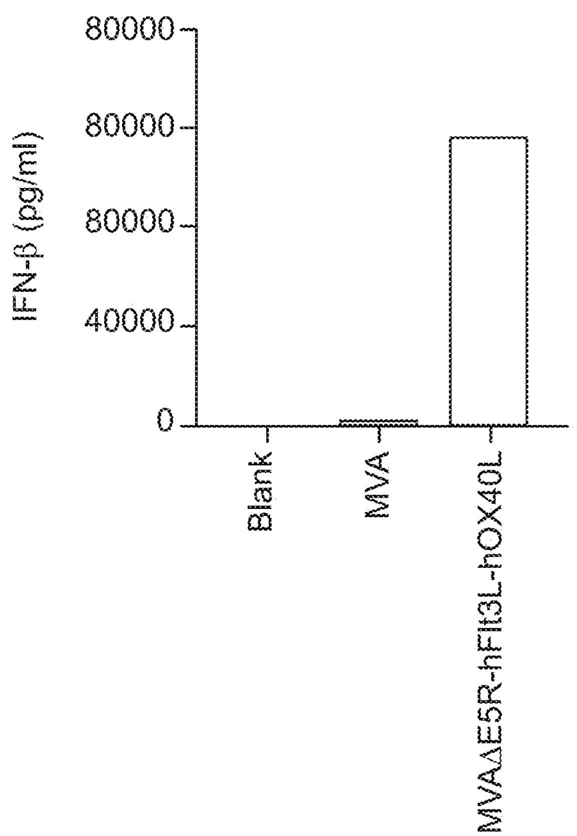

FIG. 132A shows the RT-PCR results of BMDCs that were infected with either MVA or MVAΔE5R-hFlt3L-hOX40LhOX40L at a MOI of 10. Cells were collected at 6 h post infection. RNAs were extracted and RT-PCRs were performed. FIG. 132B shows the IFN-β protein levels in BMDCs infected with either MVA or MVAΔE5R-hFlt3L-hOX40LhOX40L at a MOI of 10. Supernatants were collected at 19 h post infection. IFN-β protein levels were determined by ELISA.

Figure 133A:
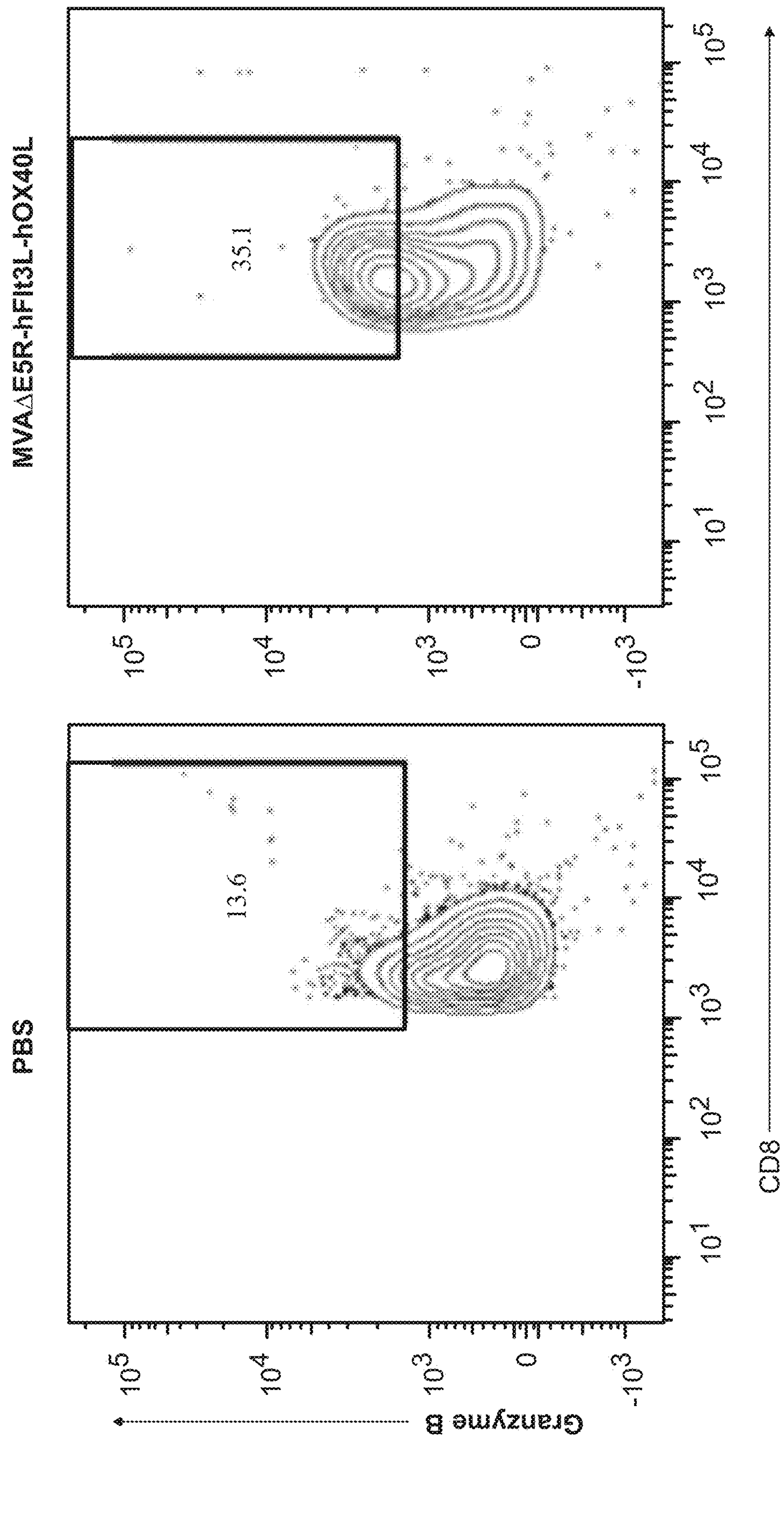
Figure 133B:
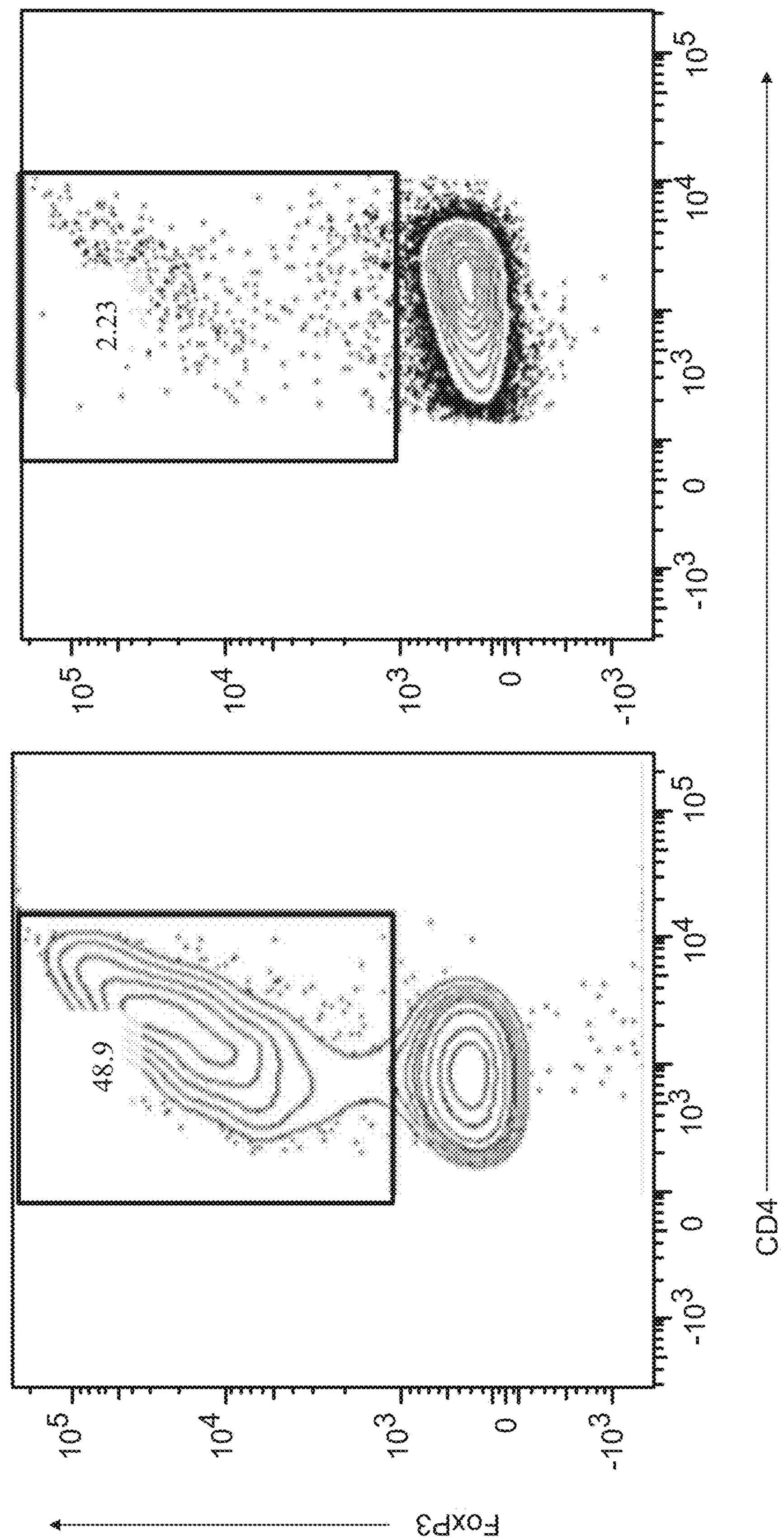

FIG. 133A shows the representative dot plots of Granzyme $B^+$ $CD8^+$ T cells in human tumors after infection with MVAΔE5R-hFl3L-mOX40L or PBS for two days. FIG. 133B shows the representative dot plots of $FoxP3^+CD4^+$ T cells in human tumors after infection with MVAΔE5R-hFl3L-mOX40L or PBS for two days.

Figure 134A:
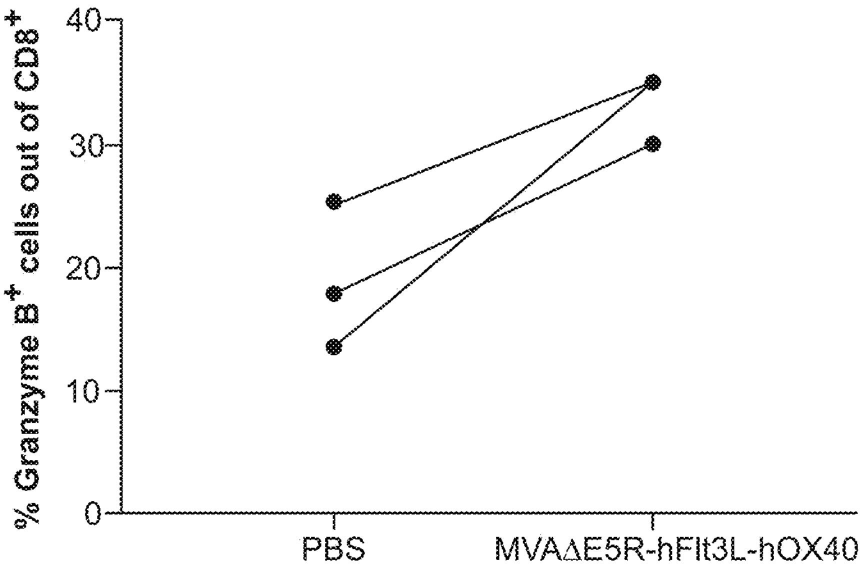
Figure 134B:
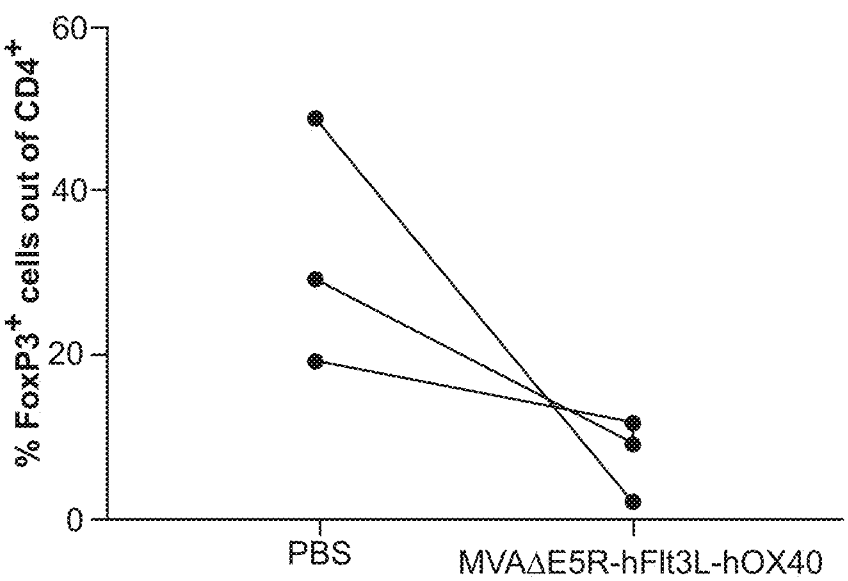

FIG. 134A shows the graph of percentages of $Granzyme^+$ $CD8^+$ T cells out of $CD8^+$ cells after infection with MVAΔE5R-hFl3L-mOX40L or PBS control for two days. Data are means ±SEM (n=3). FIG. 134B shows the graph of percentages of $FoxP3^+CD4^+$ T cells T cells out of $CD4^+$ cells after infection with MVAΔE5R-hFl3L-mOX40L or PBS control for two days. Data are means ±SEM (n=3).

FIGS. 135A-137B are graphical representations of data showing MVAΔE3LΔE5R induces higher levels of type I IFN in BMDCs and B16-F10 melanoma cells compared with MVAΔE5R or MVAΔE3L.

Figure 135A:
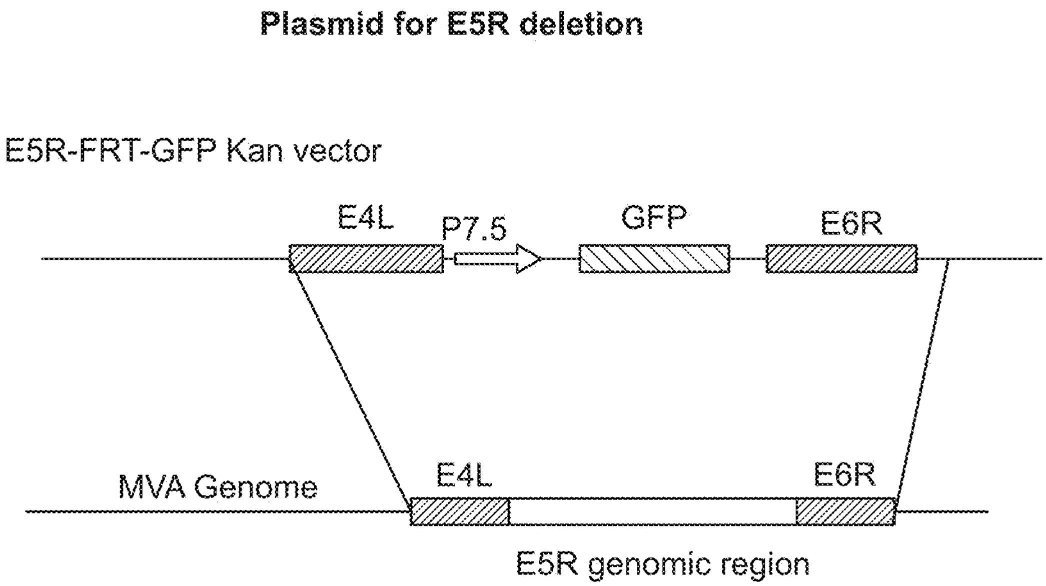
Figure 135B:
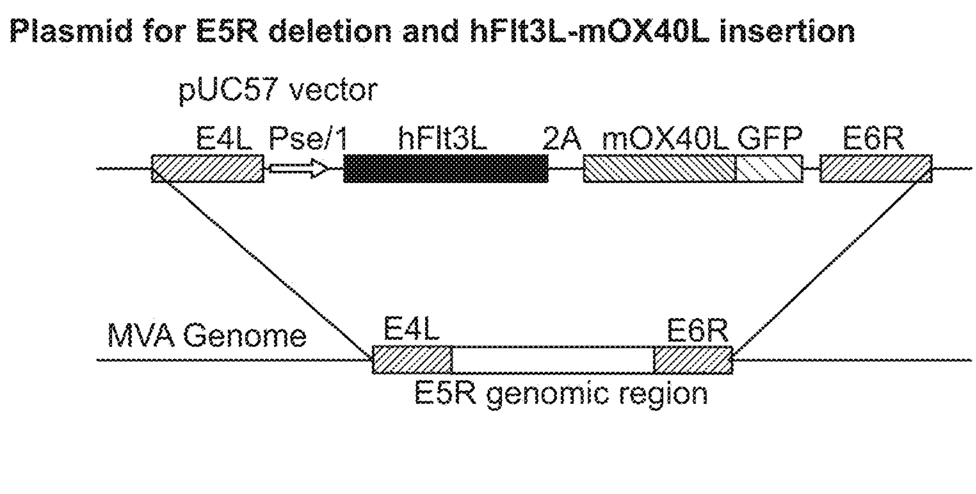
Figure 135C:
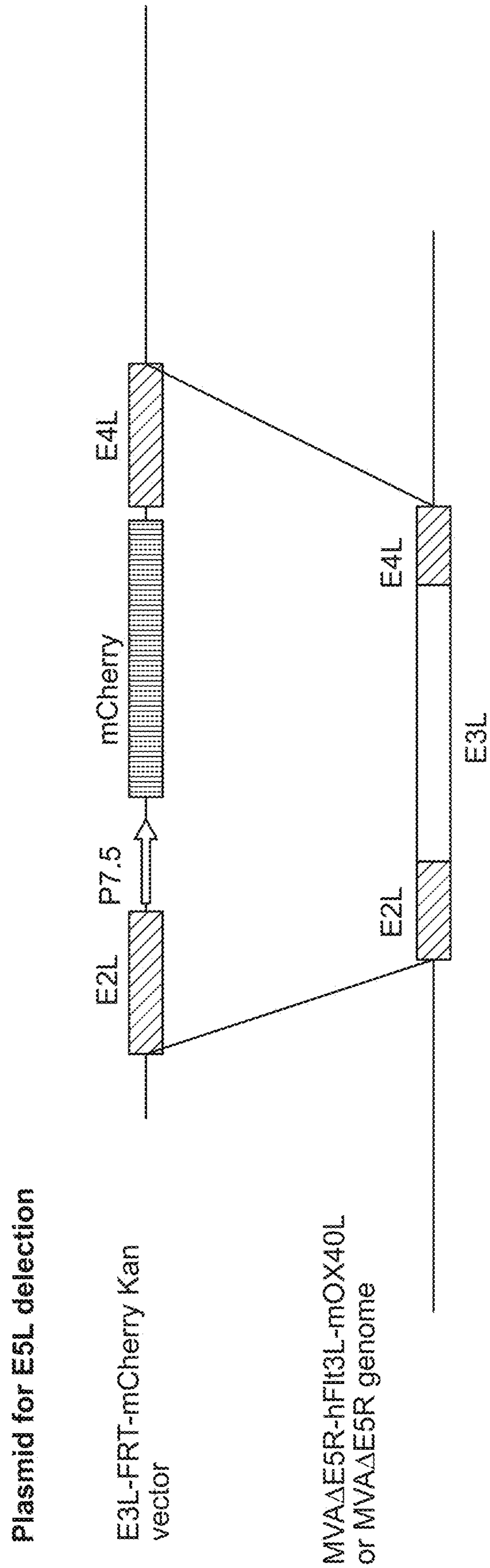

FIGS. 135A-135C show a scheme of generating recombinant MVAΔE3LΔE5R and MVAΔE3LΔE5R-hFl3L-mOX40L through homologous recombination at the E2L and E4L loci of the MVAΔE5R or MVAΔE5R-hFl3L-mOX40L genome. Homologous recombination that occurred at the E2L and E4L loci results in the deletion of E3L gene from the MVAΔE5R or MVAΔE5R-hFl3L-mOX40L genome.

Figure 136:
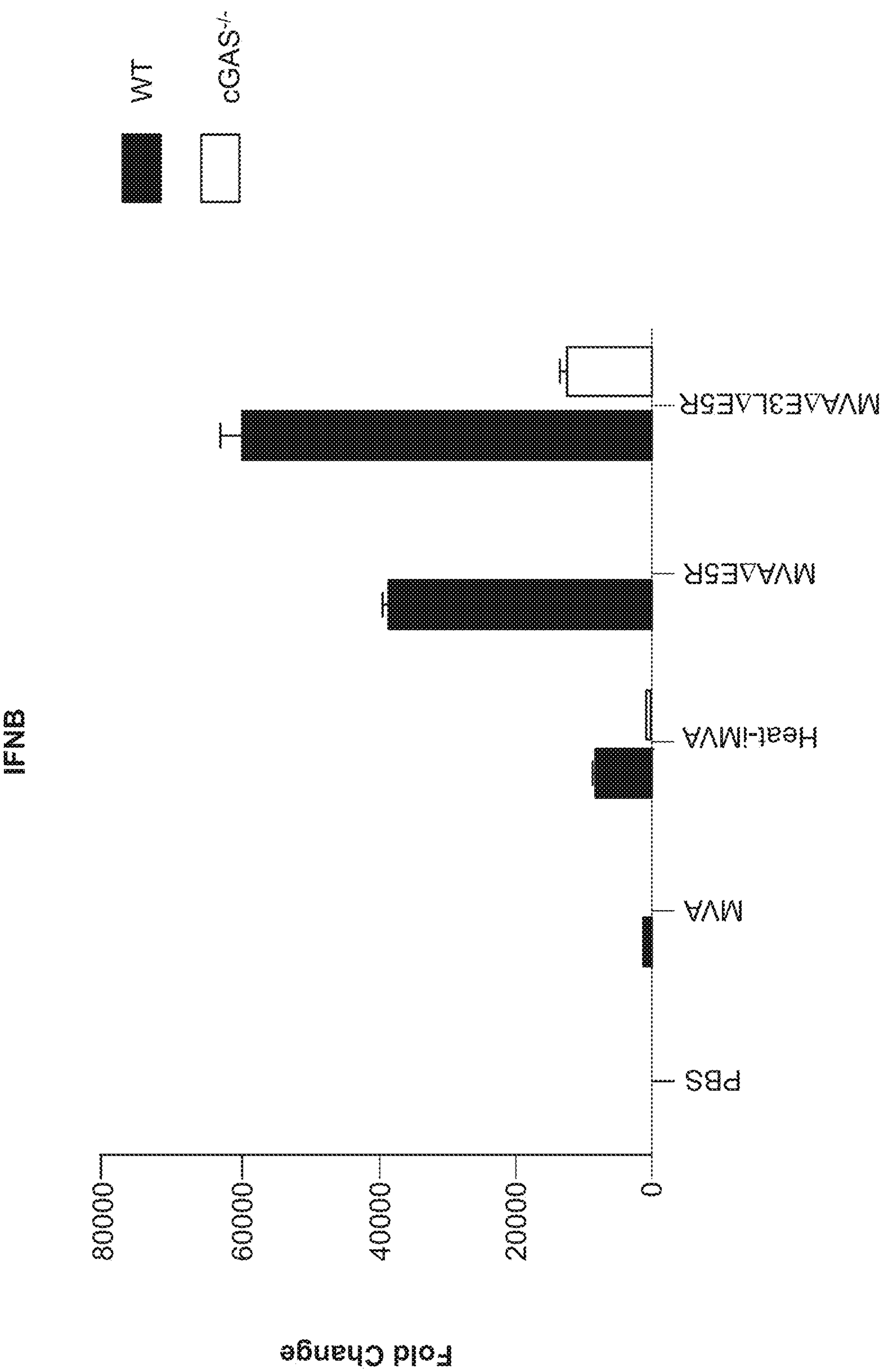

FIG. 136 shows that MVAΔE3LΔE5R infection of BMDCs induced higher levels of IFNB gene expression compared with MVAΔE5R, MVA, or Heat-iMVA. BMDCs from WT or $cGAS^{-/-}$ mice were infected with MVA, Heat-iMVA, MVAΔE5R, or MVAΔE3LΔE5R at a MOI of 10. Cells were collected at 6 h post infection and RNAs were extracted. Quantitative RT-PCR analyses were performed to examine the expression of IFNB gene.

Figure 137A:
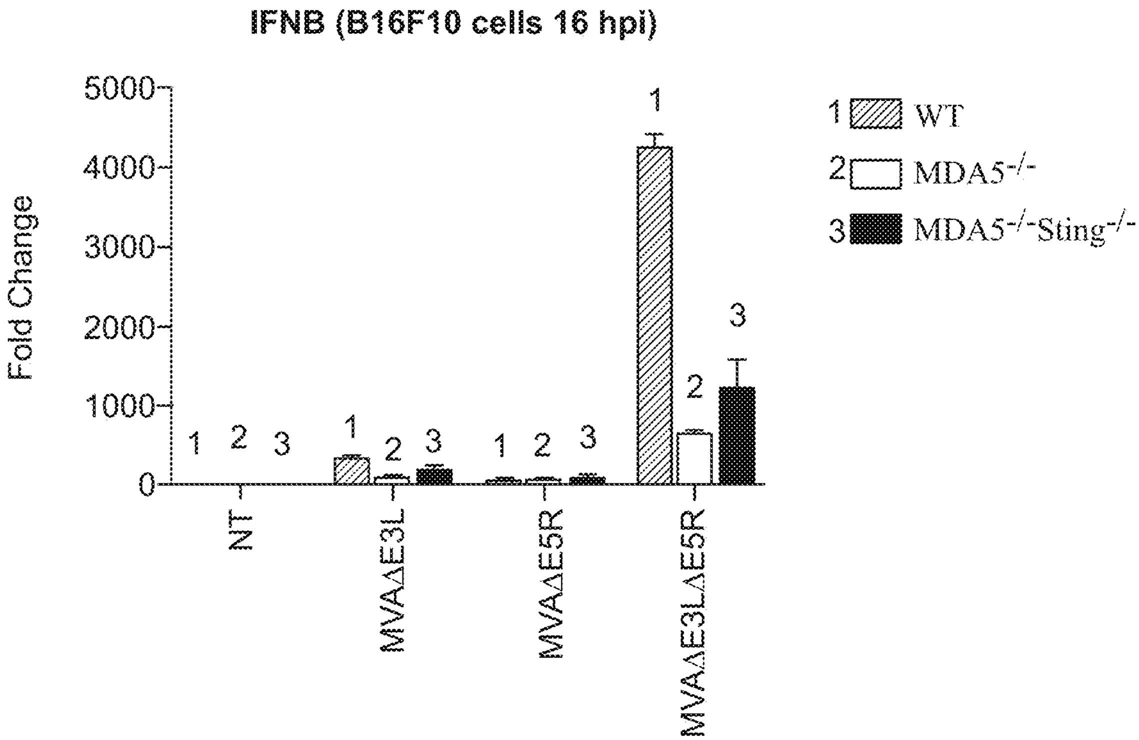
Figure 137B:
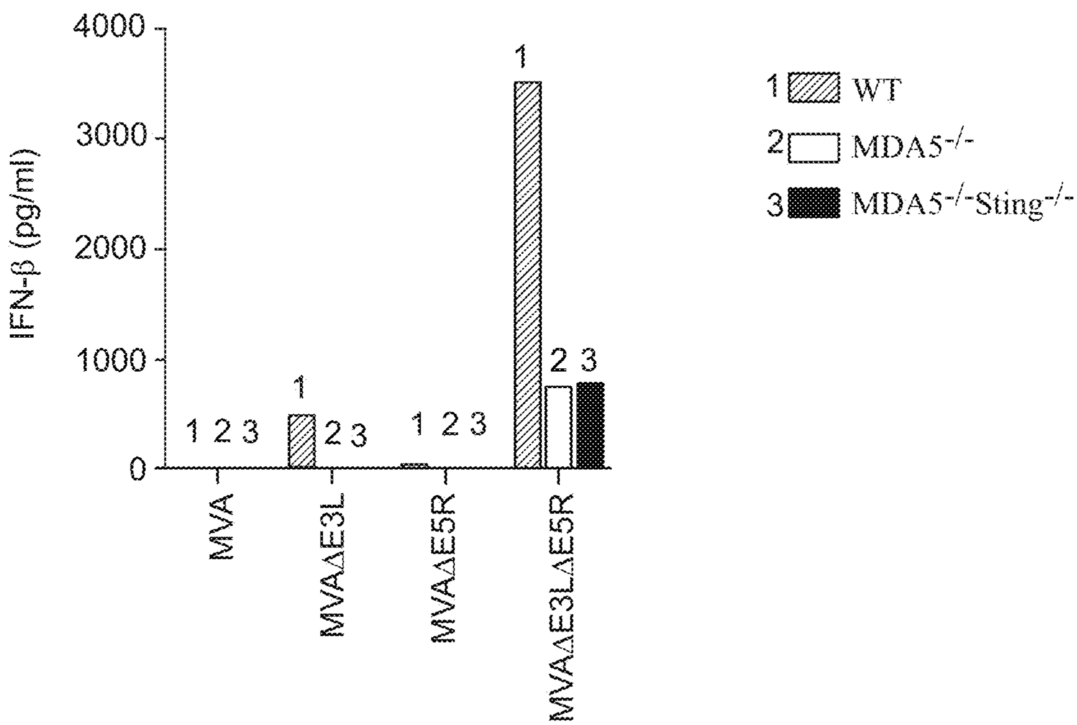

FIGS. 137A-137B show that MVAΔE3LΔE5R infection of murine B16-F10 melanoma cells induces higher levels of IFNB gene expression and IFN-β protein secretion compared with MVAΔE3L or MVAΔE5R. FIG. 137A shows the quantitative RT-PCR analyses with WT or $MDA5^{-/-}$, or $STING^{-/-}MDA5^{-/-}$ B16-F10 cells infected with MVAΔE3L, or MVAΔE5R or MVAΔE3LΔE5R at a MOI of 10. Cells were collected at 16 h post infection and RNAs were extracted. Quantitative RT-PCR analyses were performed to examine the expression of IFNB gene. FIG. 137B shows the IFN-β protein levels in WT or $MDA5^{-/-}$, or $STING^{-/-}MDA5^{-/-}$B16-F10 cells infected with MVAΔE3L, or MVAΔE5R, or MVAΔE3LΔE5R at a MOI of 10. Supernatants were collected at 24 h post infection and IFN-β protein levels in the supernatants were determined by ELISA.

Figure 138:
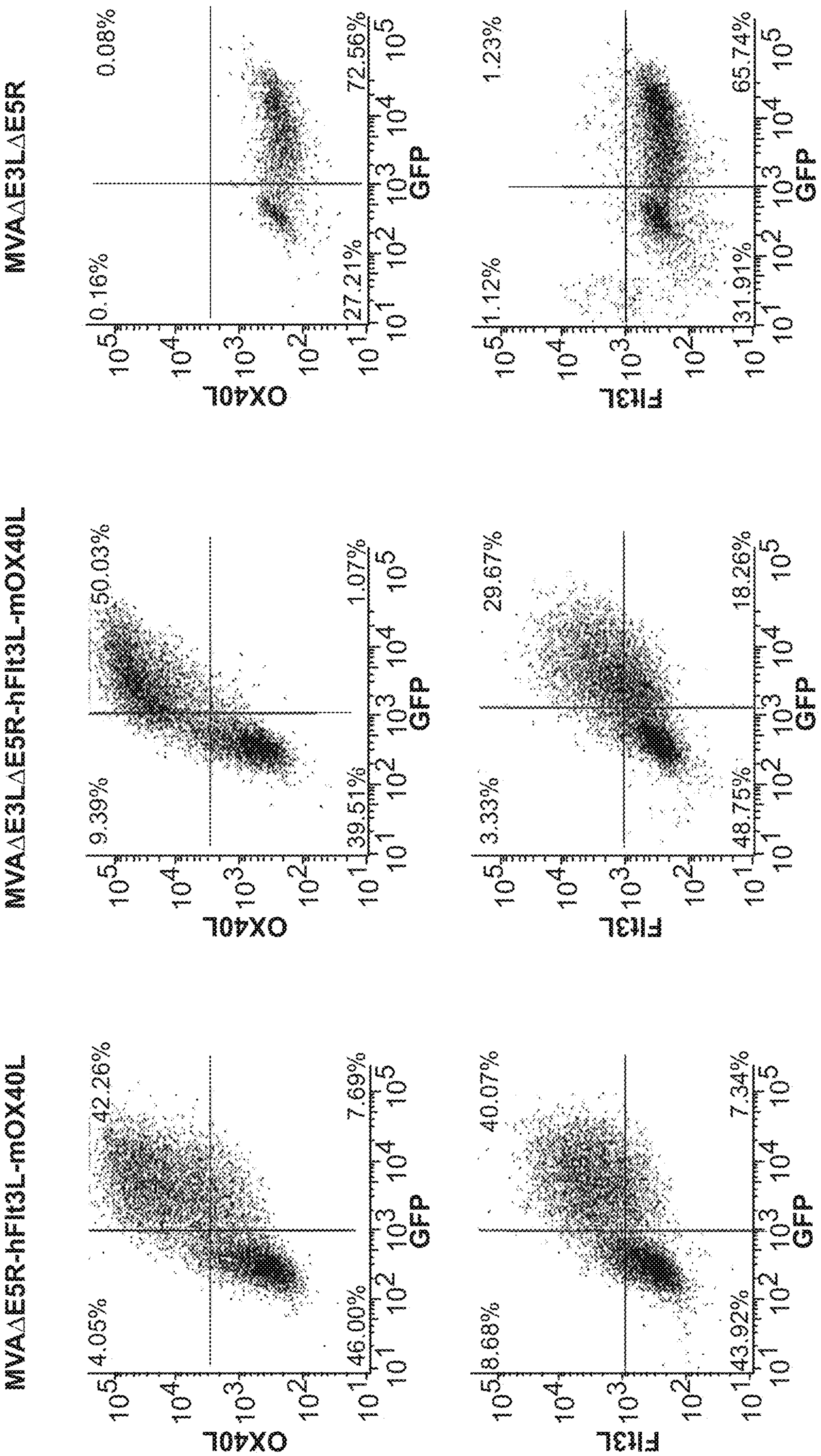
Figure 139A:
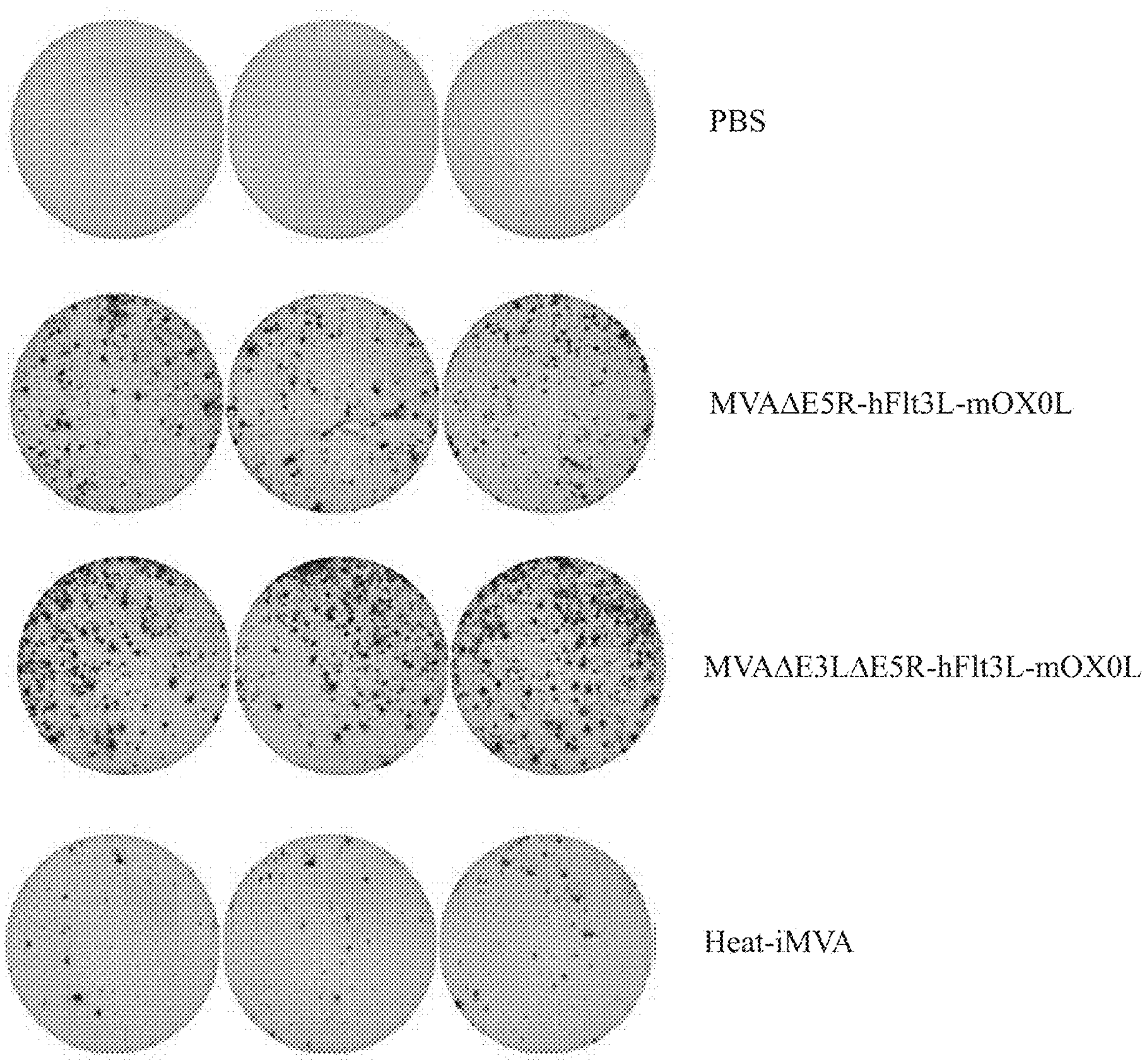
Figure 139B:
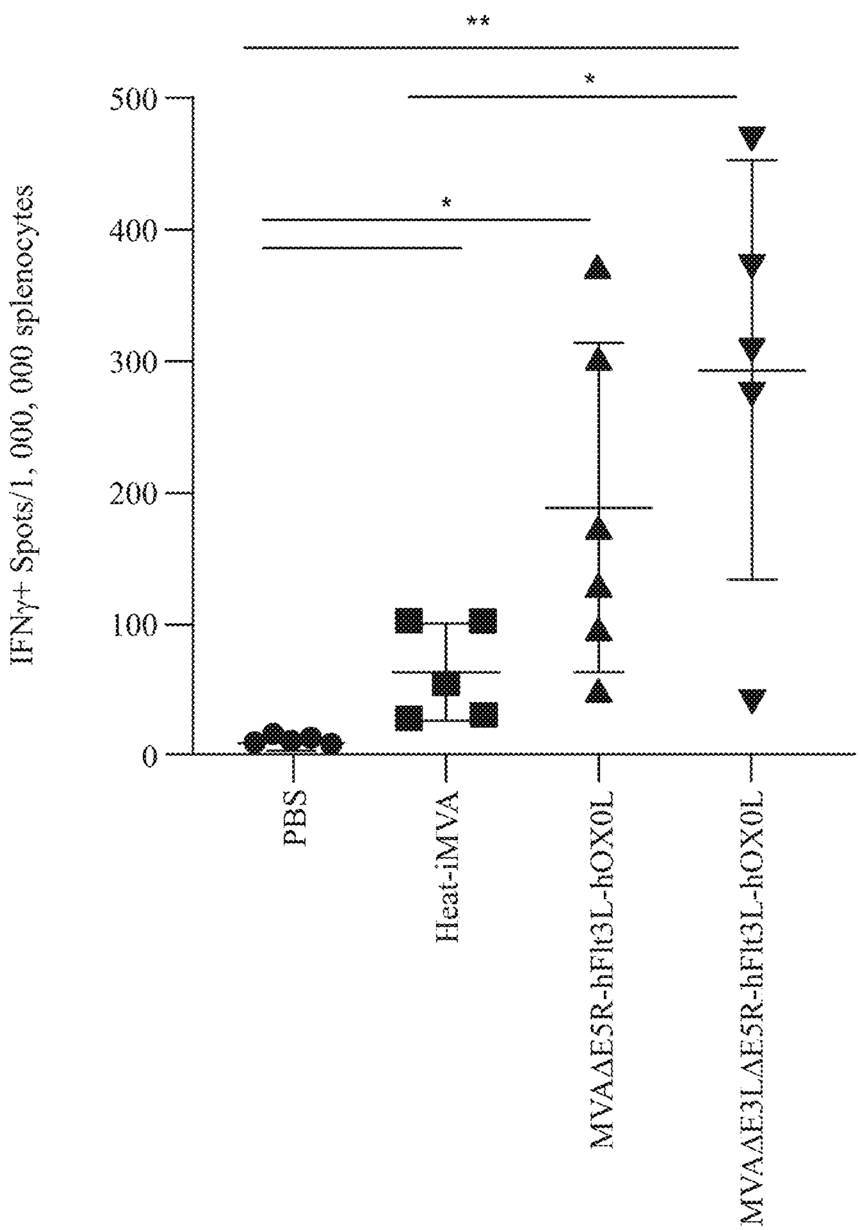

FIGS. 138-139B are graphical representations of data showing MVAΔE3LΔE5R-hFl3L-mOX40L expressed human Flt3L and murine OX40L transgenes in B16-F10 melanoma cells and intratumoral delivery of MVAΔE3LΔE5R-hFl3L-mOX40L induced stronger systemic antitumor T cell responses in a B16-F10 murine melanoma model.

FIG. 138 shows the FACS data demonstrating the mOX40L and hFl3L expression on B16-F10 cells infected with either MVAΔE5R-hFl3L-mOX40L or with MVAΔE3LΔE5R-hFl3L-mOX40L. B16-F10 cells were infected with either MVAΔE5R-hFl3L-mOX40L, or with MVAΔE3LΔE5R-hFl3L-mOX40L, or with MVAΔE3LΔE5R at a MOI of 10. Cells were washed 1 h later and harvested at 24 h post infection. Cells were strained with anti-mOX40L or anti-hFl3L antibody for FACS.

FIGS. 139A-139B shows that intratumoral injection of MVAΔE3LΔE5R-hFl3L-mOX40L generated stronger anti-tumor-specific T cells in the spleens compared with MVAΔE5R-hFl3L-mOX40L. Briefly, B16-F10 melanoma cells were implanted intradermally to the left and right flanks of C57B/6J mice ($5\times10^5$ to the right flank and $2.5\times10^5$ to the left flank). Seven days post tumor implantation, $2\times10^7$ pfu of either MVAΔE5R-hFl3L-mOX40L, MVAΔE3LΔE5R-hFl3L-mOX40L, an equivalent amount of Heat-iMVA, or PBS was intratumorally (IT) injected into the larger tumors on the right flank twice, three days apart. Spleens were harvested at 2 days post second injection, ELISPOT analyses were performed to evaluate tumor-specific T cells in the spleens. ELISPOT assay was performed by co-culturing irradiated B16-F10 cells (150,000) and splenocytes (1,000,000) in a 96-well plate. FIG. 139A shows the image of ELISPOT of triplicate samples of combined splenocytes from mice in the same treatment group. FIG. 139B shows the graph of IFN-$\beta^+$ spots per 1,000,000 splenocytes. Each dot represents spleenocyte samples from an individual mouse (n=5-6) (*P<0.05; **P<0.01,/test).

Figure 140:
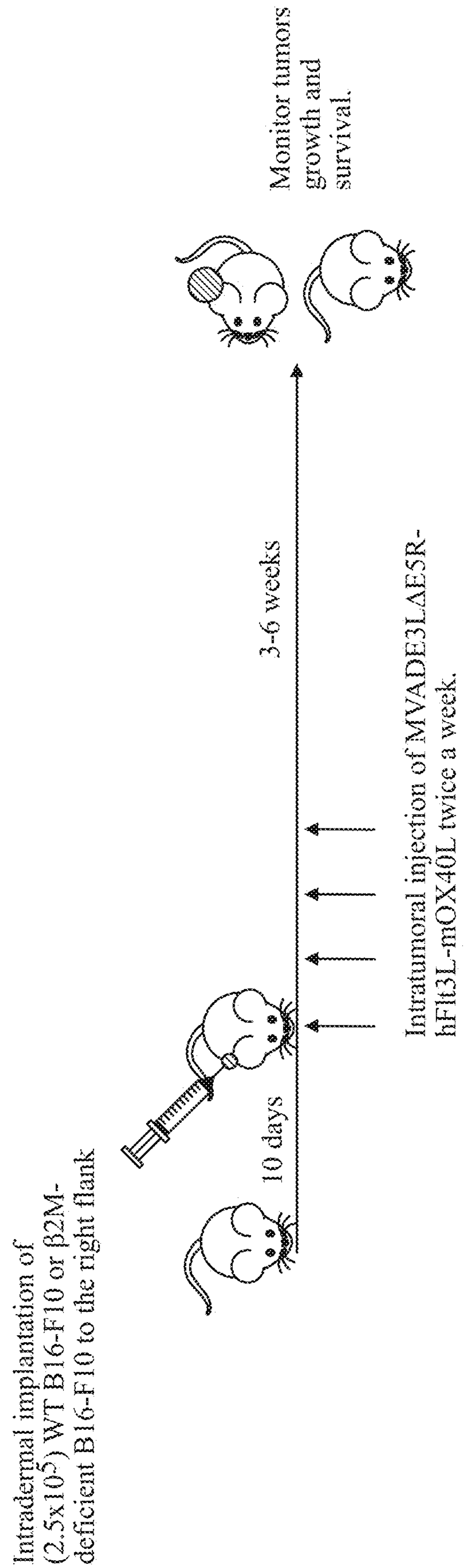
Figure 141A:
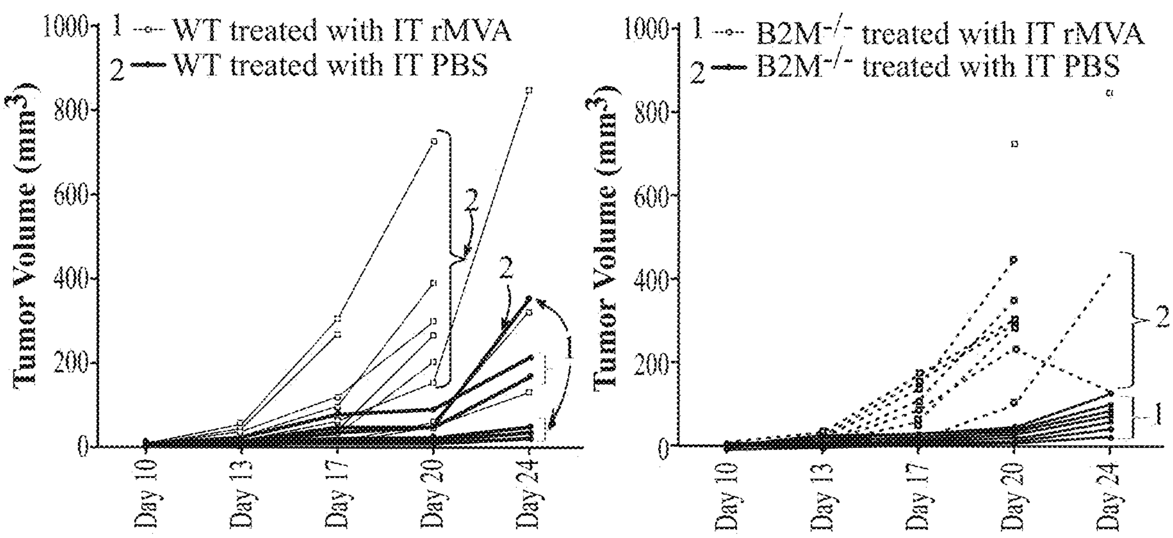
Figure 141B:
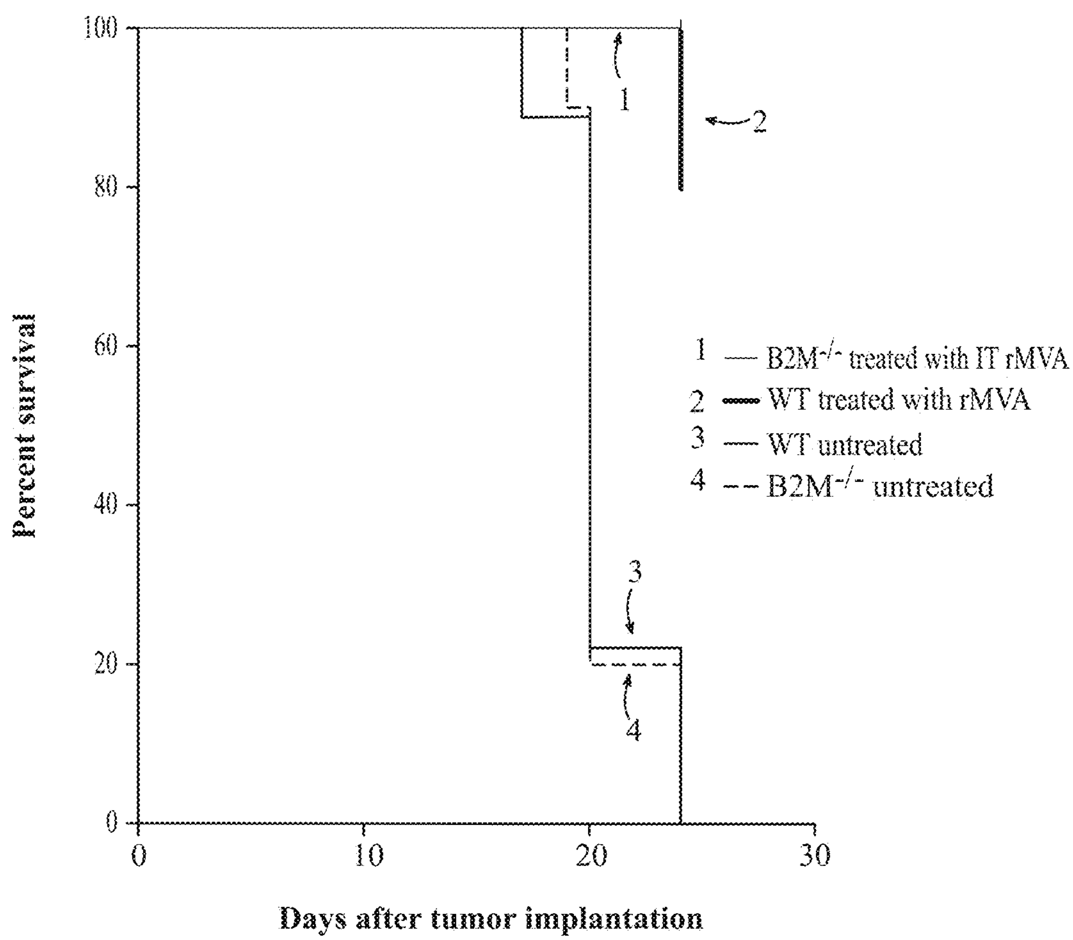

FIGS. 140-141B are graphical representations of data showing intratumoral delivery of MVAΔE3LΔE5R-hFl3L-mOX40L delayed the growth of both WT and $\beta2M^{-/-}$ B16-F10 tumor cells.

FIG. 140 shows the experimental scheme. Briefly, WT or $b2M^{-/-}$ B16-F10 tumor cells ($2\times10^5$) (which were generated by CRISPR-cas9 technology in the inventors' lab) were implanted intradermally to the right flanks of C57BL/6J mice. 10 days after tumor implantation, tumors were injected with MVAΔE3LΔE5R-hFl3L-mOX40L twice a week. Tumor volumes were measured and mice survival were monitored.

FIG. 141A shows tumor volumes of the injected WT and $b2M^{-/-}$ B16-F10 tumors in mice treated with either PBS or MVAΔE5R-hFl3L-mOX40L intratumorally. FIG. 141B shows the Kaplan Meier survival curve of the four groups.

FIGS. 142-148 are a series of graphical representations of data showing that intratumoral injection of MVAΔE3LΔE5R-hFl3L-mOX40L generated more activated tumor-infiltrating effector T cells and reduced percentage of macrophage and DCs in injected tumors compared with MVAΔE5R-hFl3L-mOX40L in a AT3 bilateral tumor implantation model.

Figure 142:
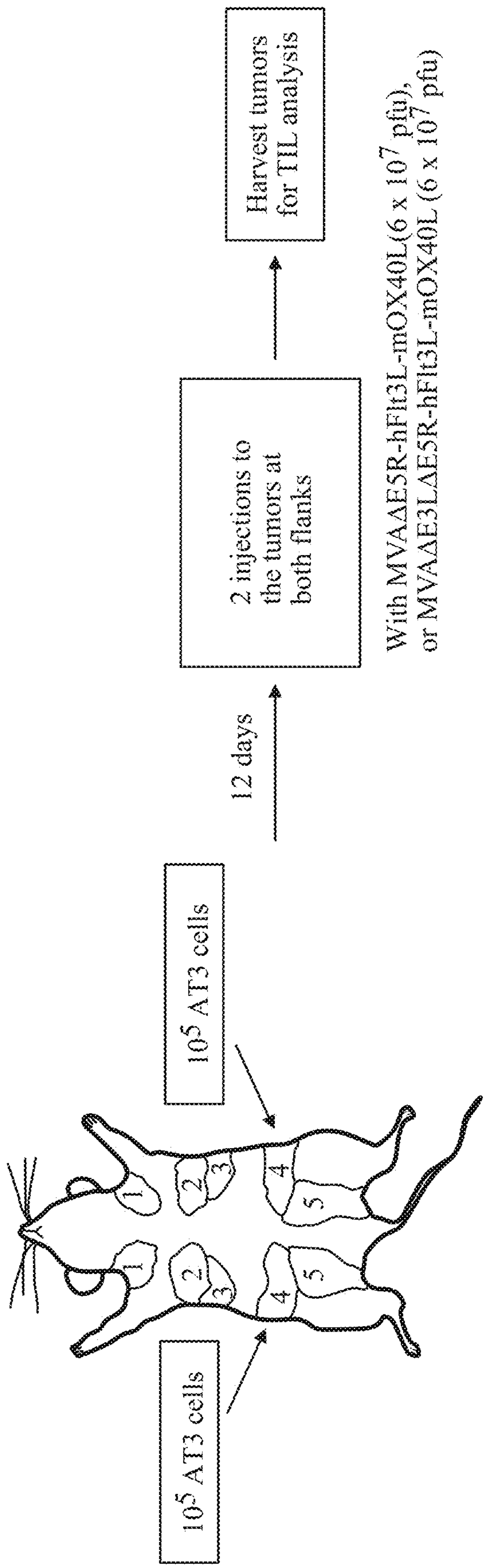

FIG. 142 shows the experimental scheme. Briefly, $10^5$ AT3 breast cancer cells were implanted into the 4th fat pad of the C57B/6J mice. Twelve days post tumor implantation, $6\times10^7$ pfu of either MVAΔE5R-hFl3L-mOX40L, MVAΔE3LΔE5R-hFl3L-mOX40L, or PBS was intratumorally (IT) injected into the tumors on both flanks twice, three days apart. Injected tumors were isolated. Tumor infiltrating lymphocytes and myeloid cells were analyzed by FACS.

Figure 143A:
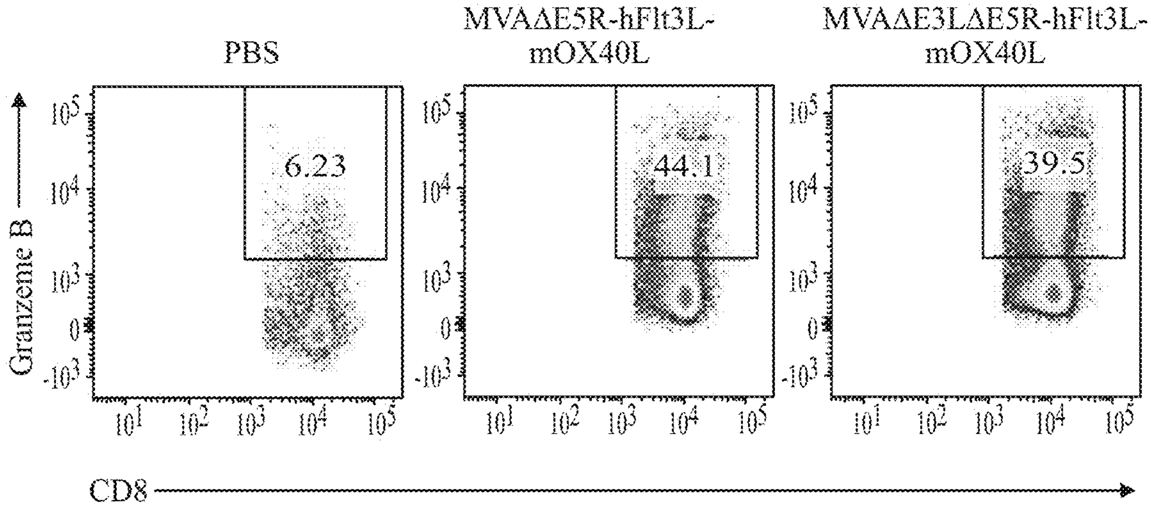
Figure 143B:
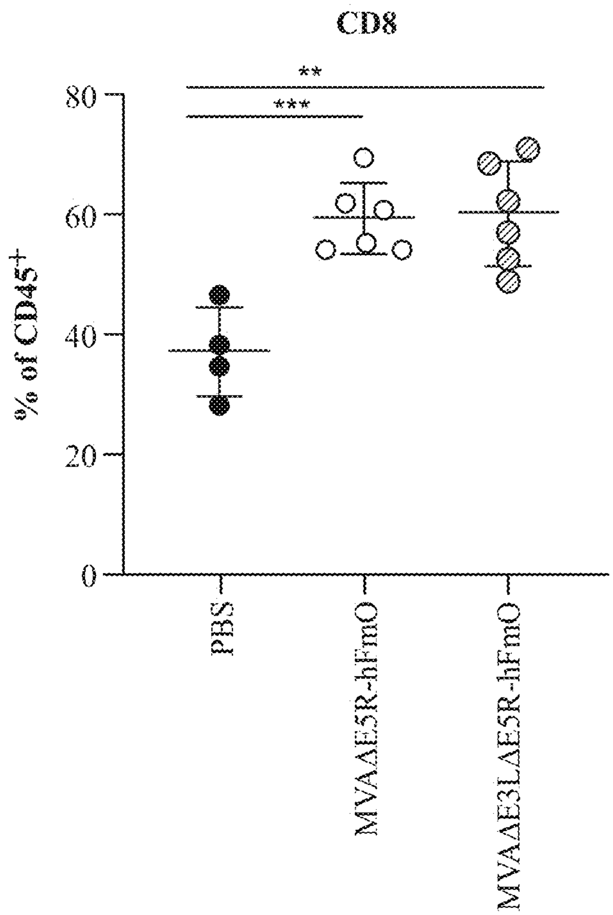
Figure 143C:
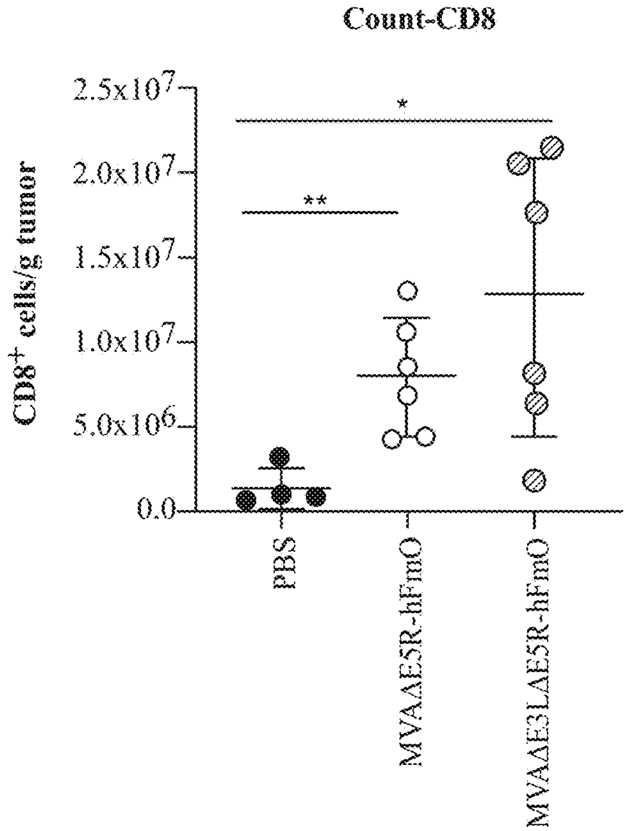
Figure 143D:
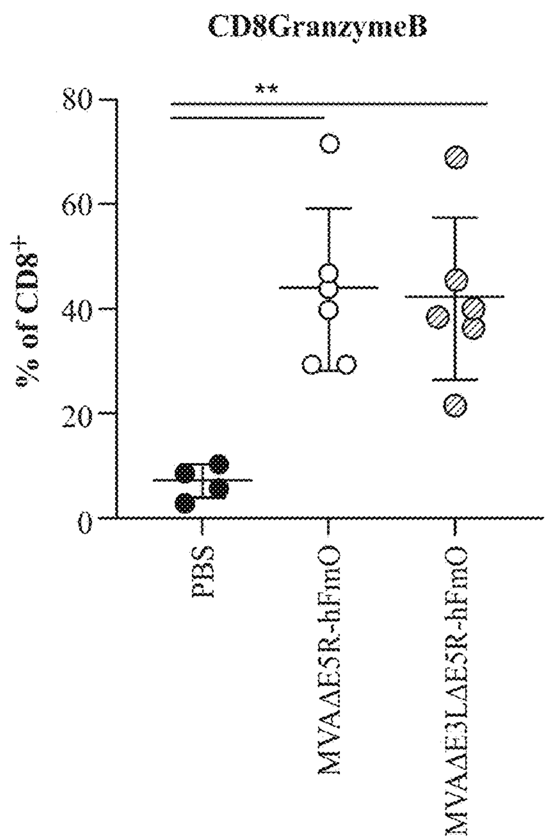
Figure 143E:
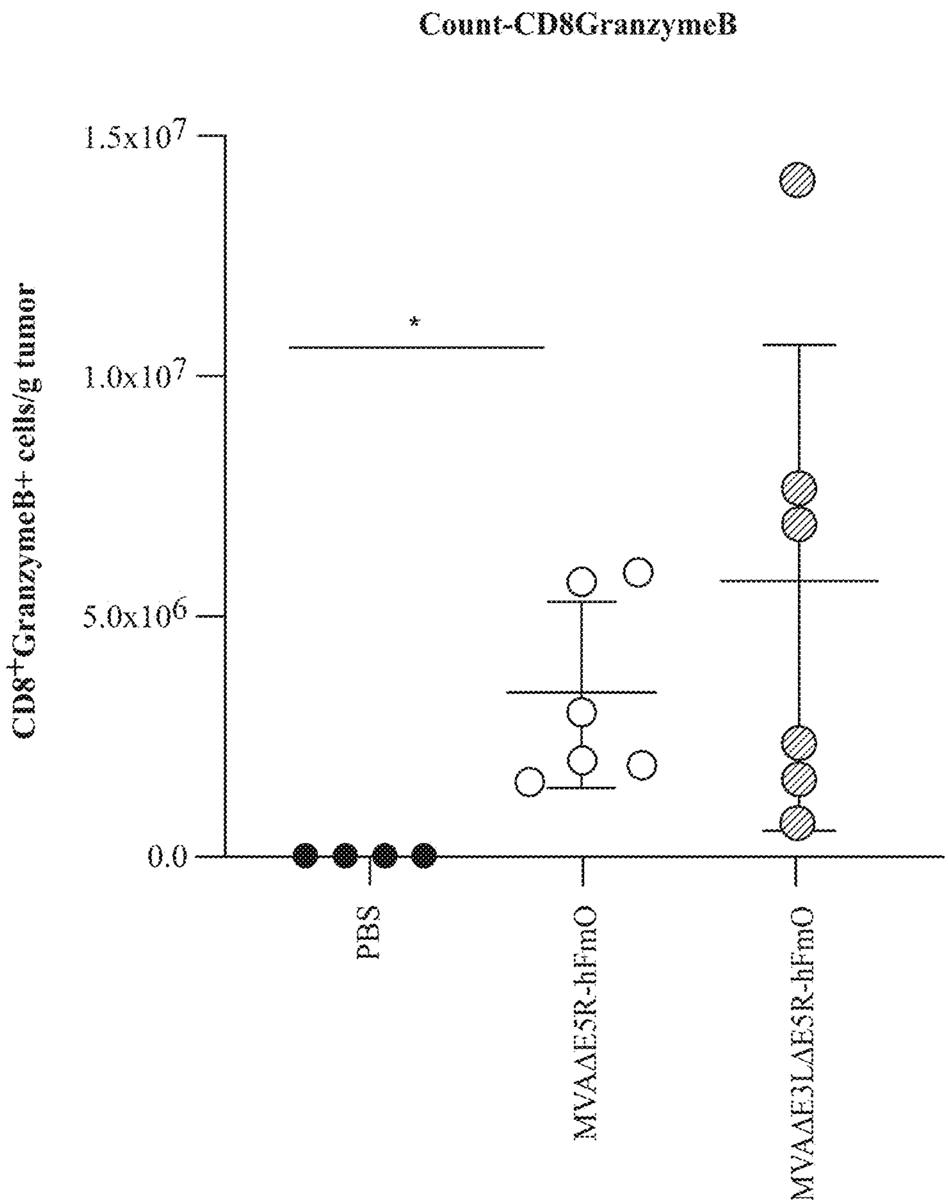

FIG. 143A shows the representative dot plots of Granzyme $B^+$ $CD8^+$ T cells in injected tumors after treatment with either MVAΔE5R-hFl3L-mOX40L, or MVAΔE3LΔE5R-hFl3L-mOX40L. FIG. 143B shows the graph of percentages of $CD8^+$ T cells out of $CD45^+$ cells. Data are means ±SEM (n=4-6). (P<0.01; *P<0.001,/test). FIG. 143C shows the graph of absolute number of $CD8^+$ T cells. Data are means ±SEM (n=4-6). (P<0.01; *P<0.001,/test). FIG. 143D shows the graph of percentages of Granzyme $B^+$ $CD8^+$ T cells out of $CD8^+$ cells. Data are means ±SEM (n=4-6) (P<0.01; *P<0.001,/test). FIG. 143E shows the graph of absolute number of Granzyme $B^+$ $CD8^+$ T cells. Data are means ±SEM (n=4-6) (P<0.01; *P<0.001,/test).

Figure 144A:
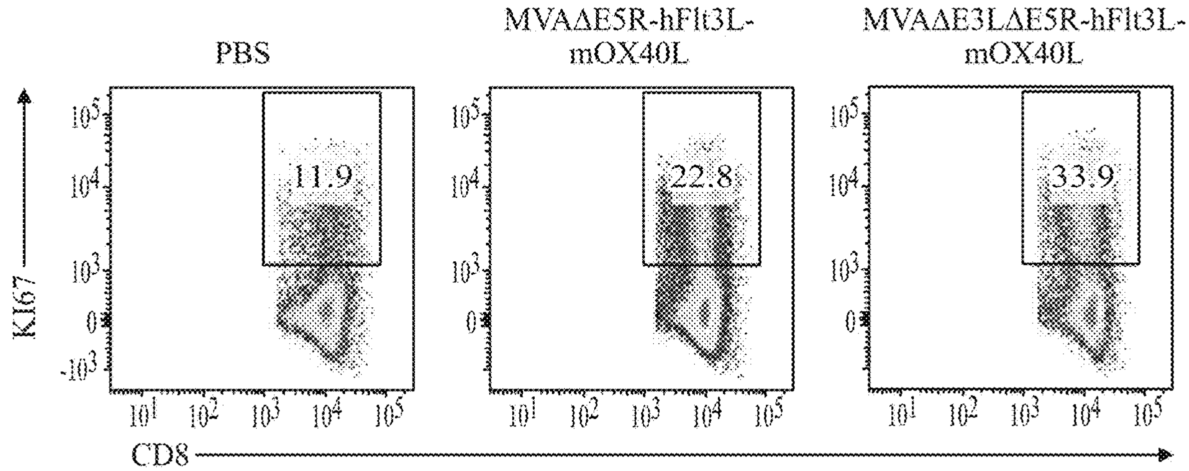
Figure 144B:
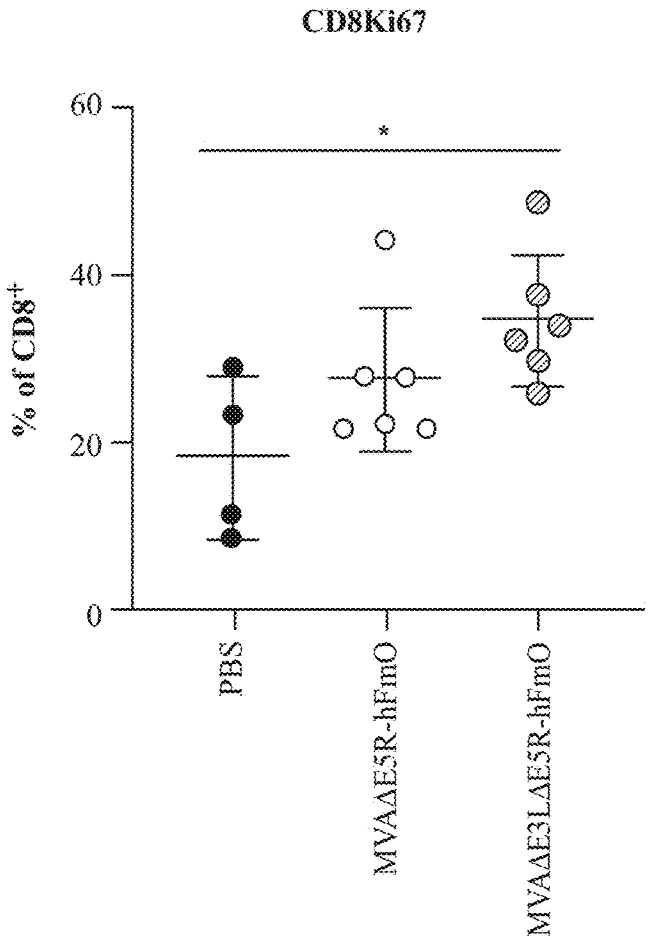
Figure 144C:
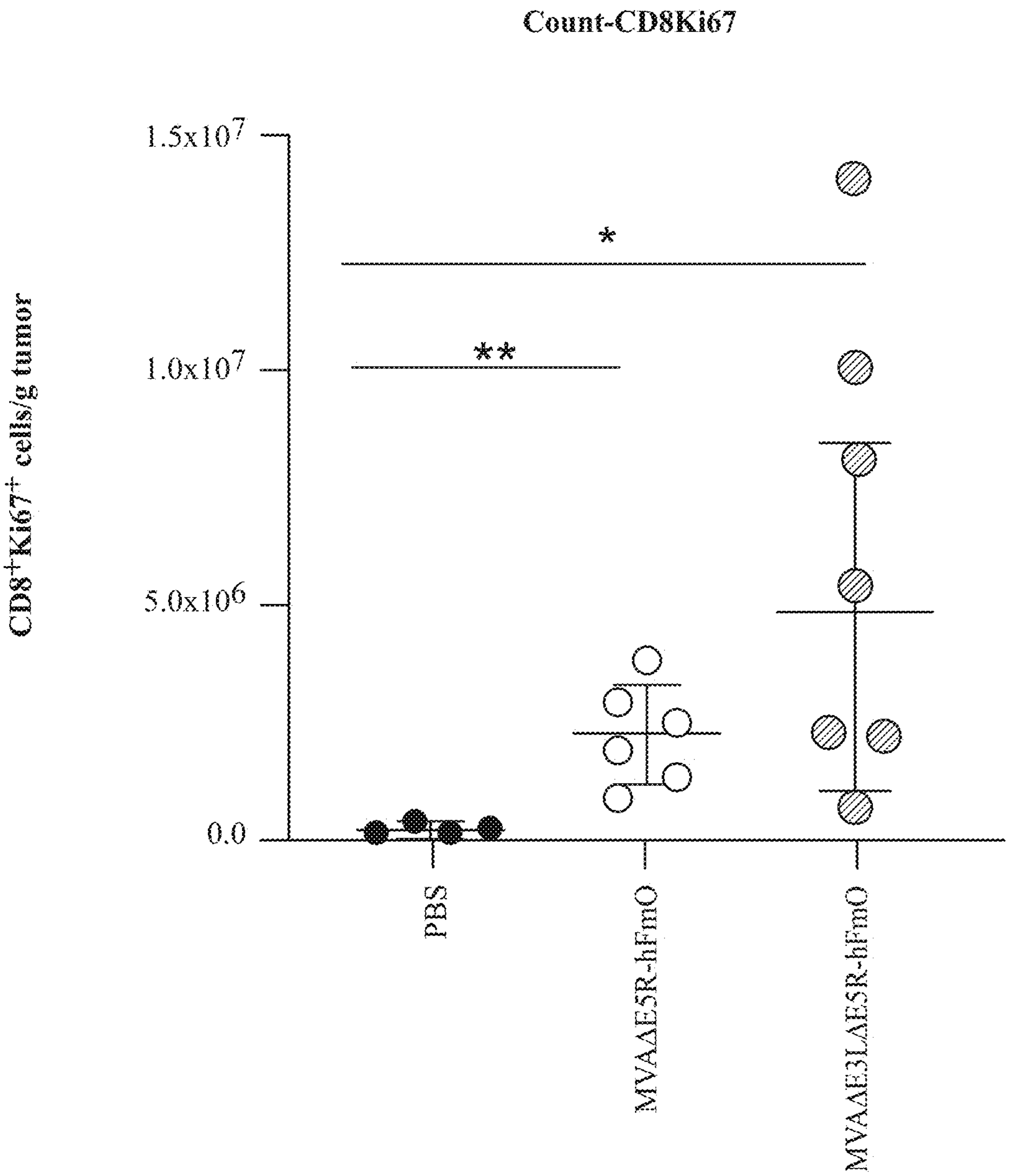

FIG. 144A shows the representative dot plots of $Ki67^+$ $CD8^+$ T cells in injected tumors after treatment with either MVAΔE5R-hFl3L-mOX40L or MVAΔE3LΔE5R-hFl3L-mOX40L. FIG. 144B shows the graph of percentages of $Ki67^+$ $CD8^+$ T cells out of $CD8^+$ cells Data are means ±SEM (n=4-6) (P<0.01; *P<0.001,/test). FIG. 144C shows the graph of absolute number of $Ki67^+$ $CD8^+$ T cells. Data are means ±SEM (n=4-6) (P<0.01; *P<0.001,/test).

Figure 145A:
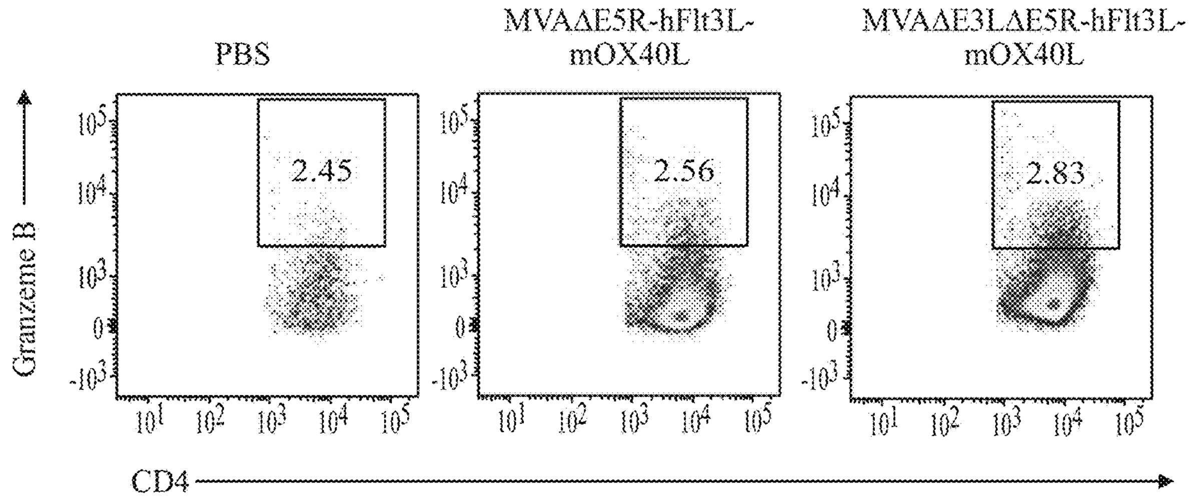
Figure 145B:
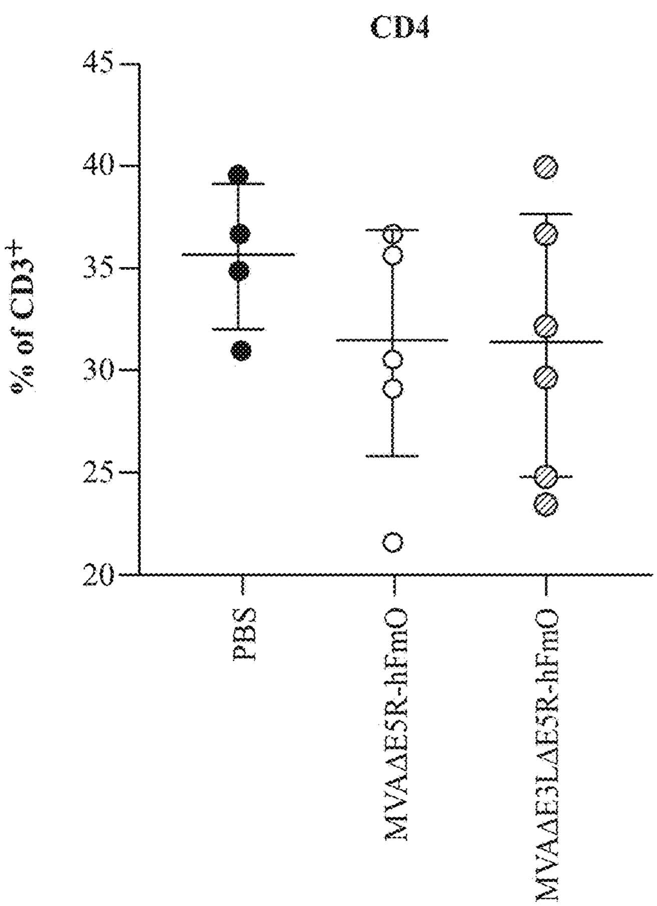
Figure 145C:
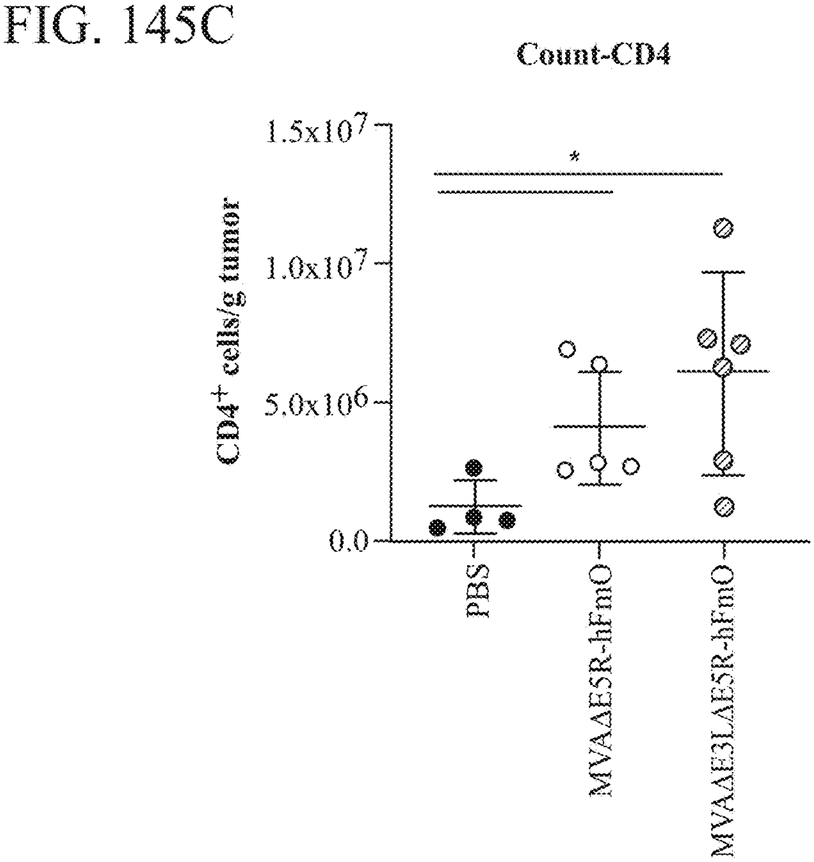
Figure 145D:
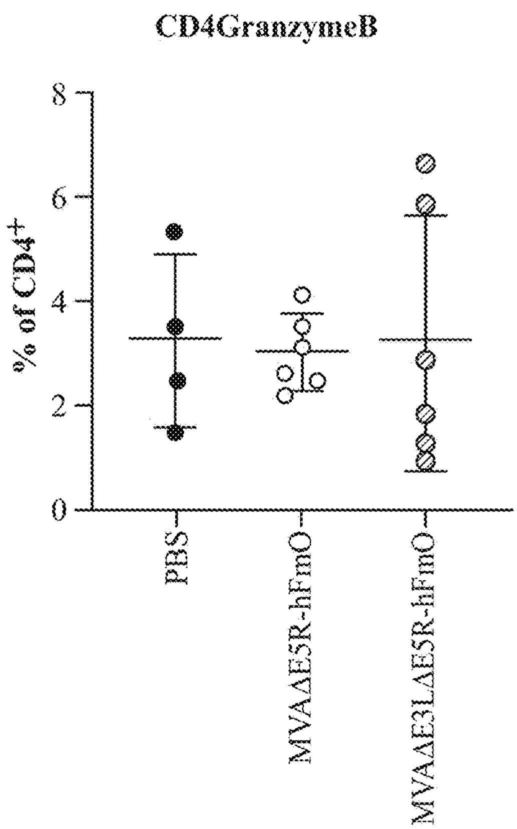
Figure 145E:
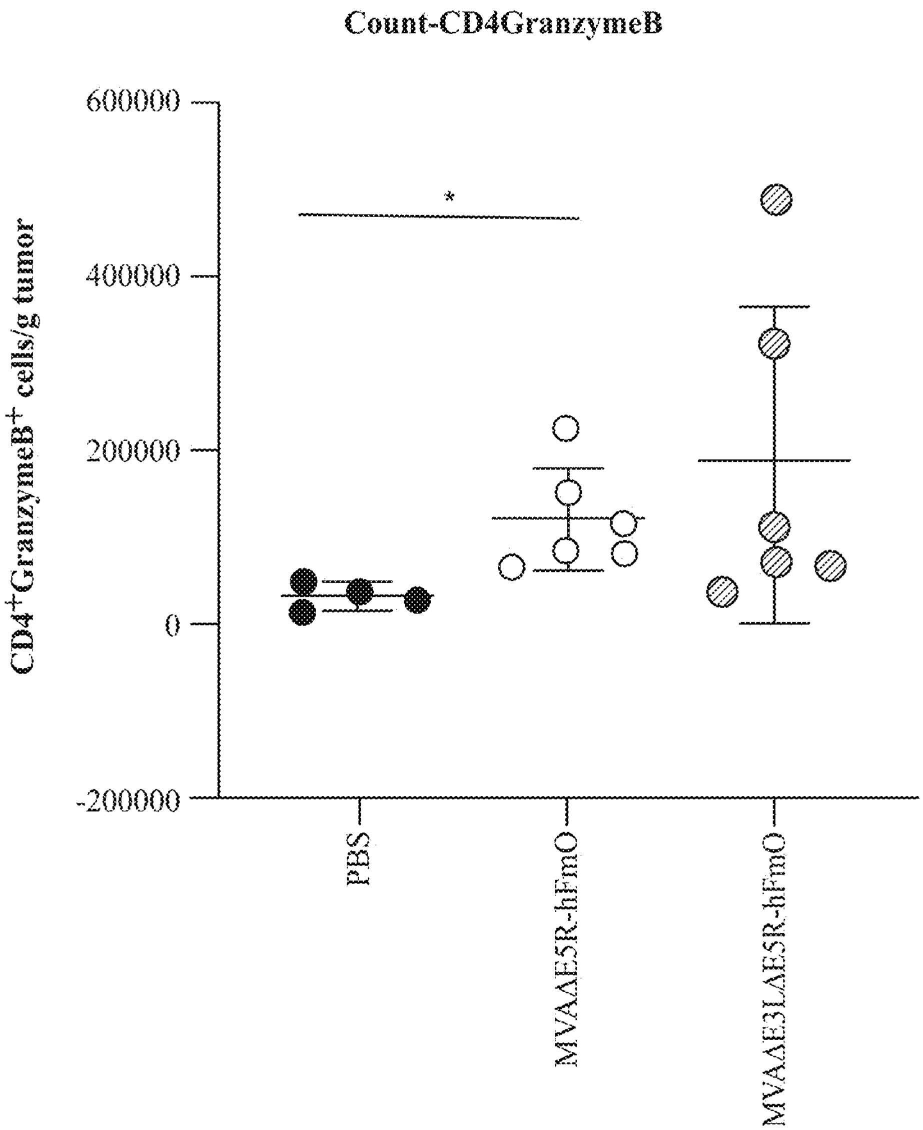

FIG. 145A shows the representative dot plots of Granzyme $B^+$ $CD4^+$ T cells in injected tumors after treatment with either MVAΔE5R-hFl3L-mOX40L or MVAΔE3LΔE5R-hFl3L-mOX40L. FIG. 145B shows the graph of percentages of $CD4^+$ T cells out of $CD3^+$ cells. Data are means ±SEM (n=4-6). (P<0.01; *P<0.001, t test). FIG. 145C shows the graph of absolute number of $CD4^+$ T cells. Data are means ±SEM (n=4-6). (P<0.01; *P<0.001, t test). FIG. 145D shows the graph of percentages of Granzyme $B^+$ $CD4^+$ T cells out of $CD4^+$ cells. Data are means ±SEM (n=4-6) (P<0.01; *P<0.001, t test). FIG. 145E shows the graph of absolute number of Granzyme $B^+$ $CD4^+$ T cells. Data are means ¤T cells. Data aP<0.01; ***P<0.001, t test).

Figure 146A:
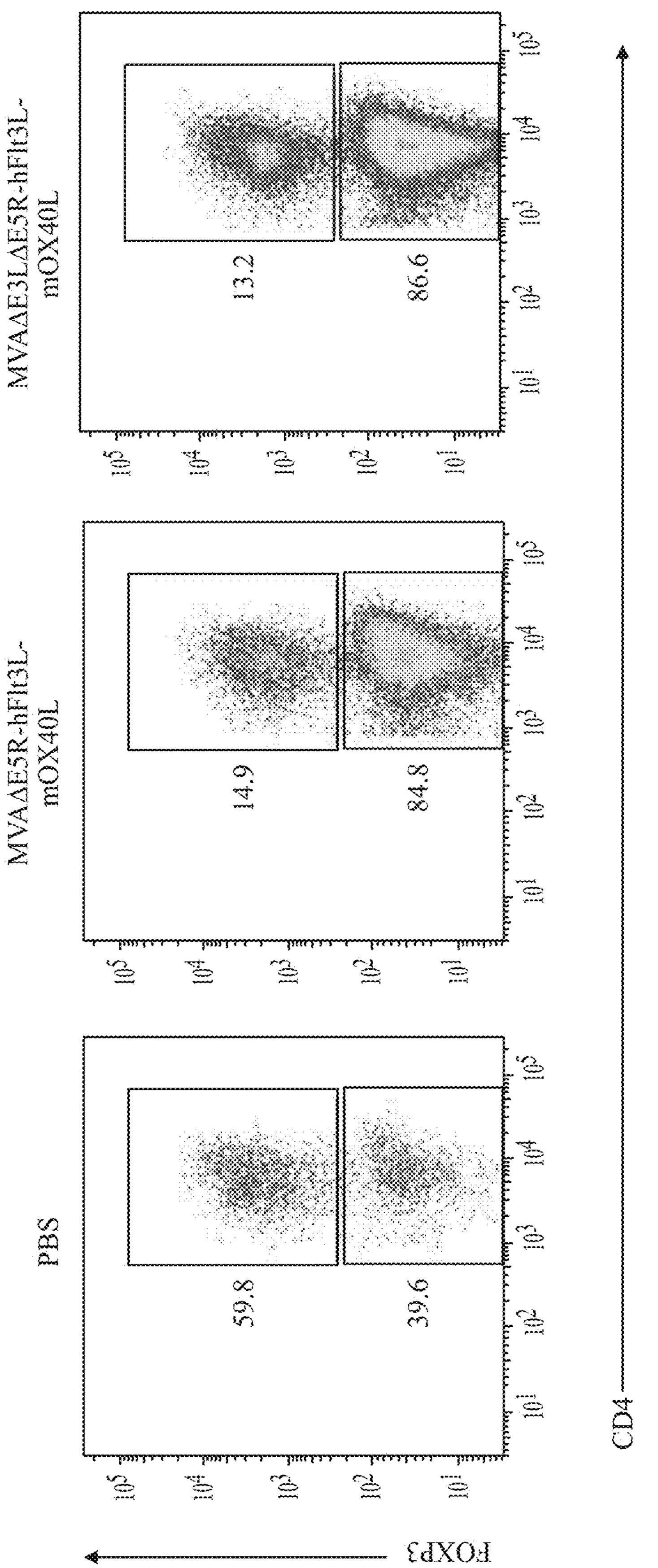
Figure 146B:
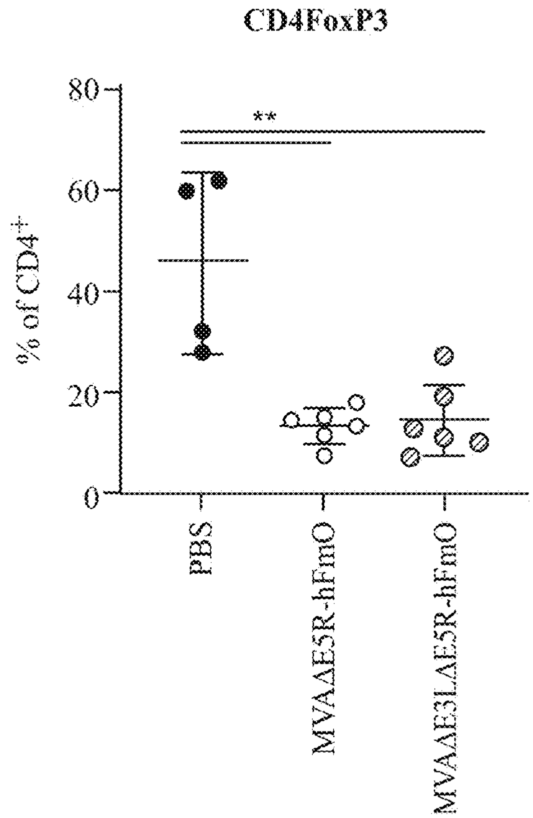
Figure 146C:
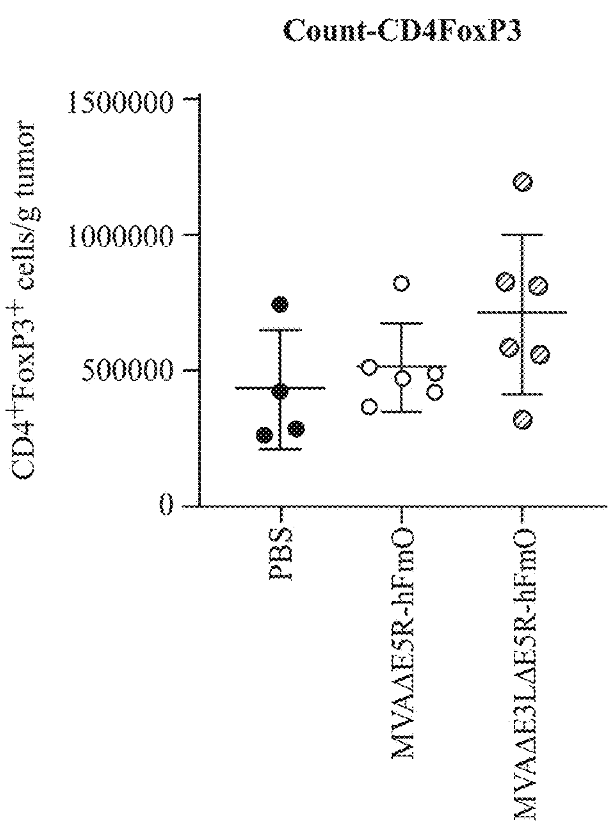

FIG. 146A shows the representative dot plots of $FoxP3^+$ $CD4^+$ T cells in injected tumors after treatment with either MVAΔE5R-hFl3L-mOX40L or MVAΔE3LΔE5R-hFl3L-mOX40L. FIG. 146B shows the graph of percentages of $FoxP3^+CD4^+$ T cells out of $CD4^+$ cells. Data are means ±SEM (n=4-6). (P<0.01; *P<0.001, t test). FIG. 146C shows the graph of absolute number of $FoxP3^+CD4^+$ T cells. Data are means ±SEM. Data are P<0.01; ***P<0.001, t test).

Figure 147A:
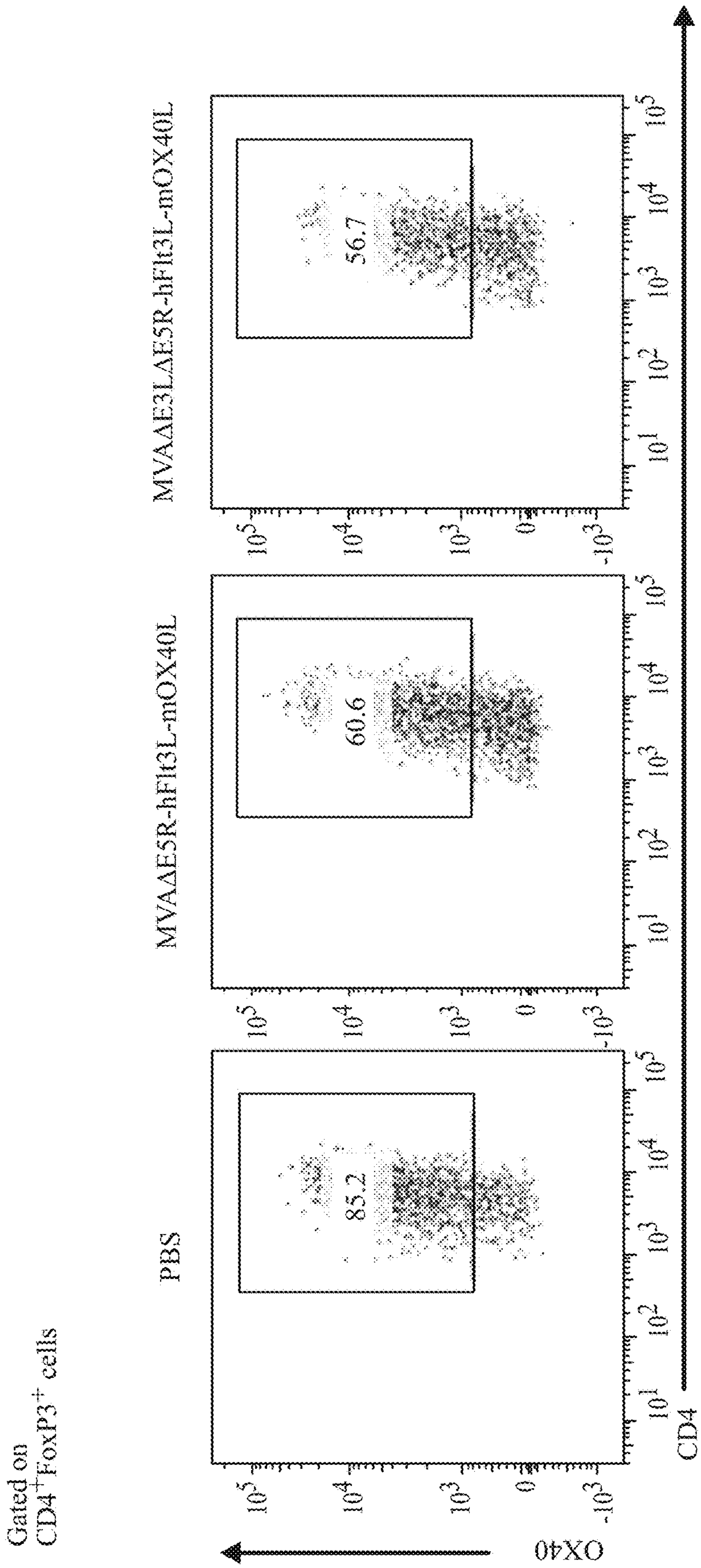
Figure 147B:
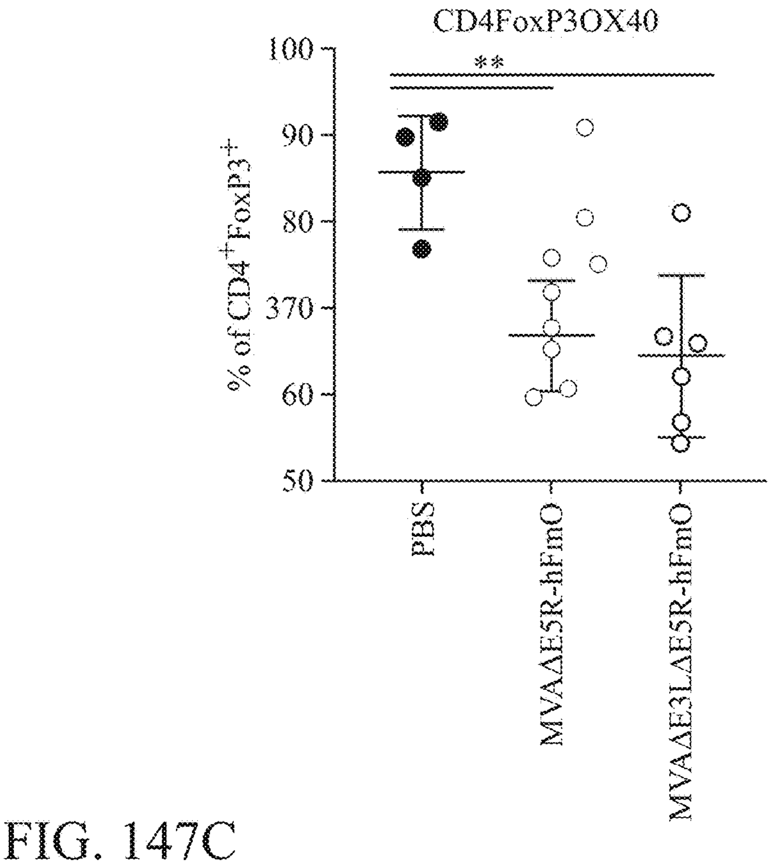
Figure 147C:
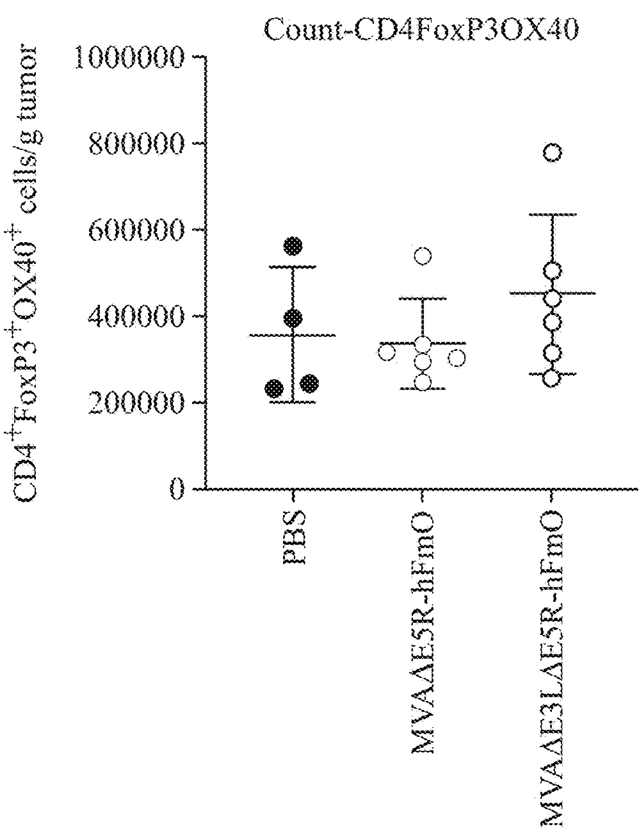

FIG. 147A shows the representative dot plots of $OX40^+$ $FoxP3^+$ $CD4^+$ T cells in injected tumors after treatment with either MVAΔE5R-hFl3L-mOX40L or MVAΔE3LΔE5R-hFl3L-mOX40L. FIG. 147B shows the graph of percentages of $OX40^+FoxP3^+CD4^+$ T cells out of $FoxP3^+CD4^+$ cells. Data are means ±SEM (n=4-6). (P<0.01; *P<0.001, t test). FIG. 147C shows the graph of absolute number of $OX40^+FoxP3^+CD4^+$ T cells. Data are means ±SEM (n=4-6). (P<0.01; *P<0.001, t test).

Figure 148A:
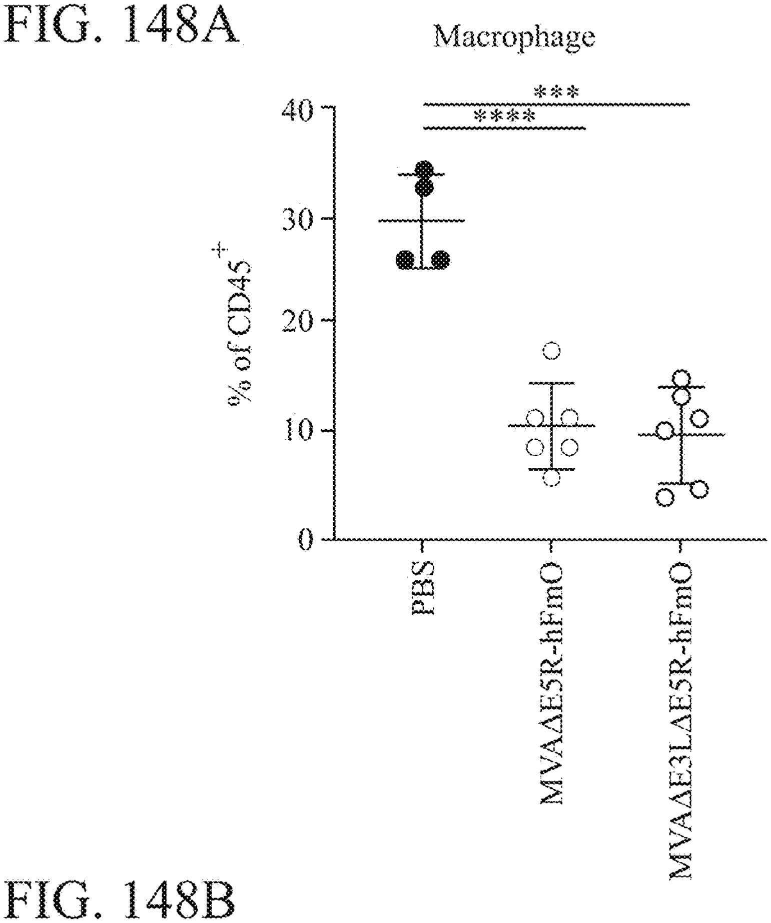
Figure 148B:
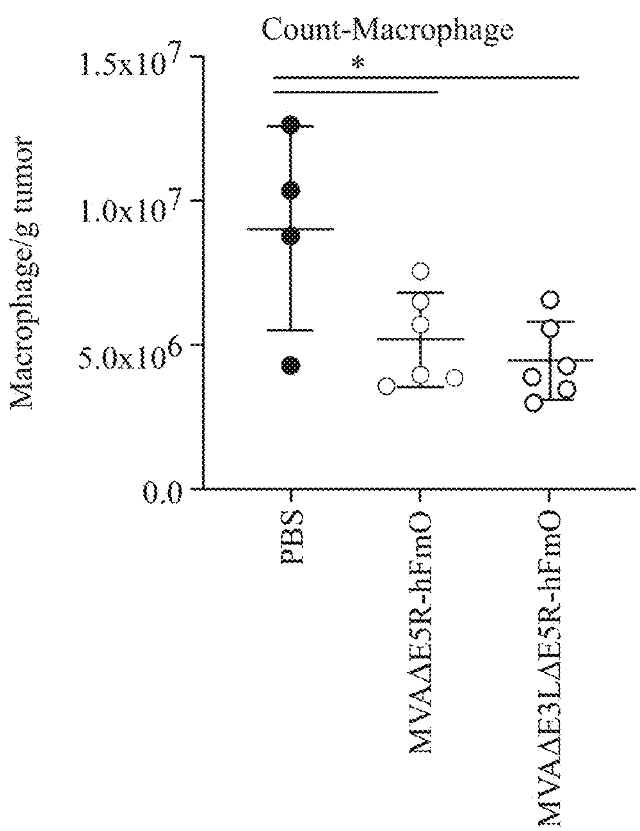
Figure 148C:
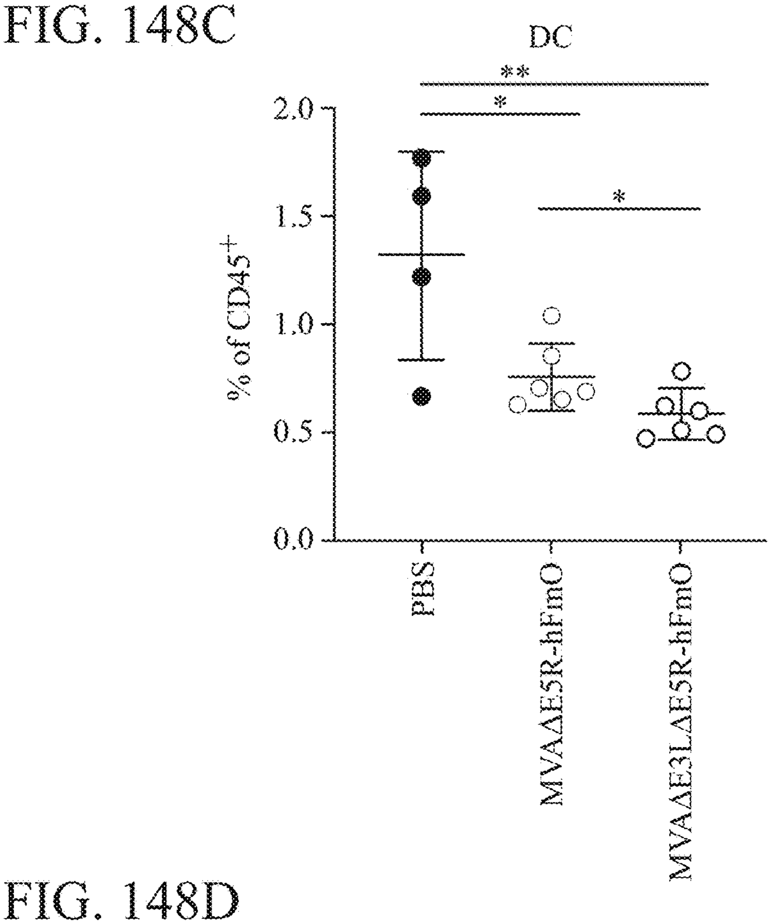
Figure 148D:
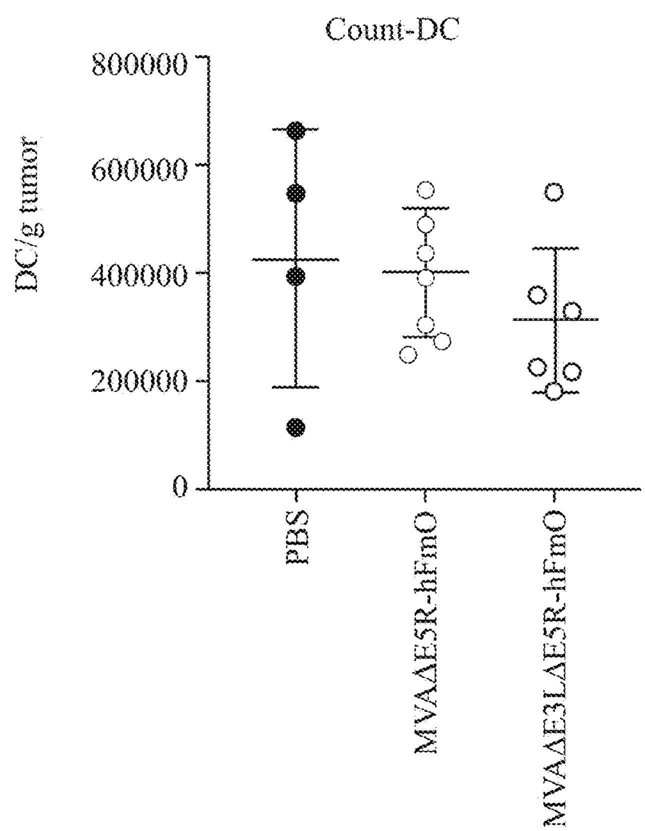
Figure 148E:
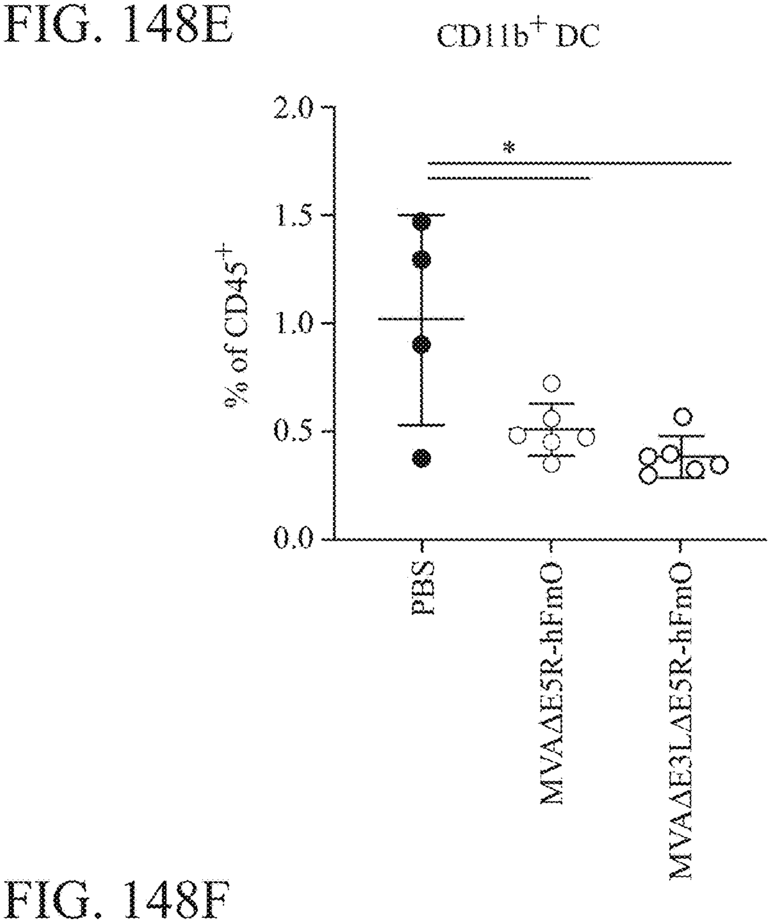
Figure 148F:
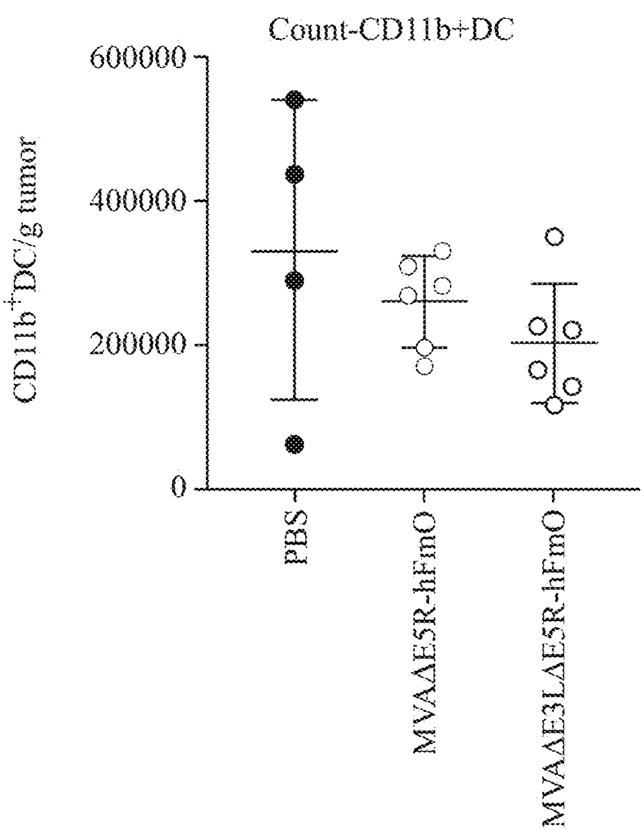
Figure 148G:
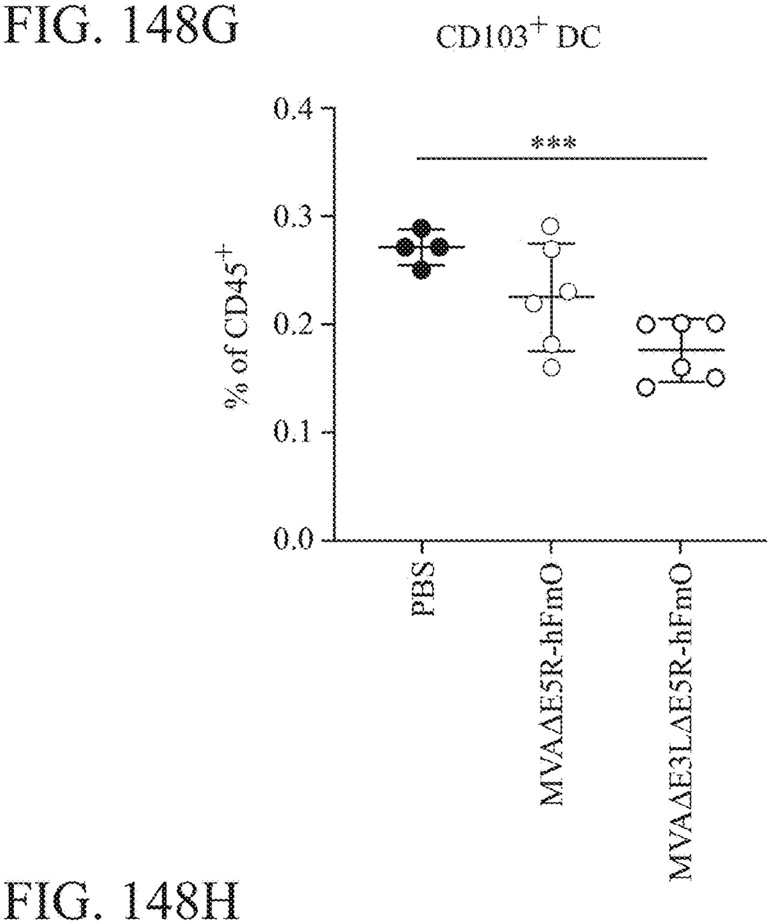
Figure 148H:
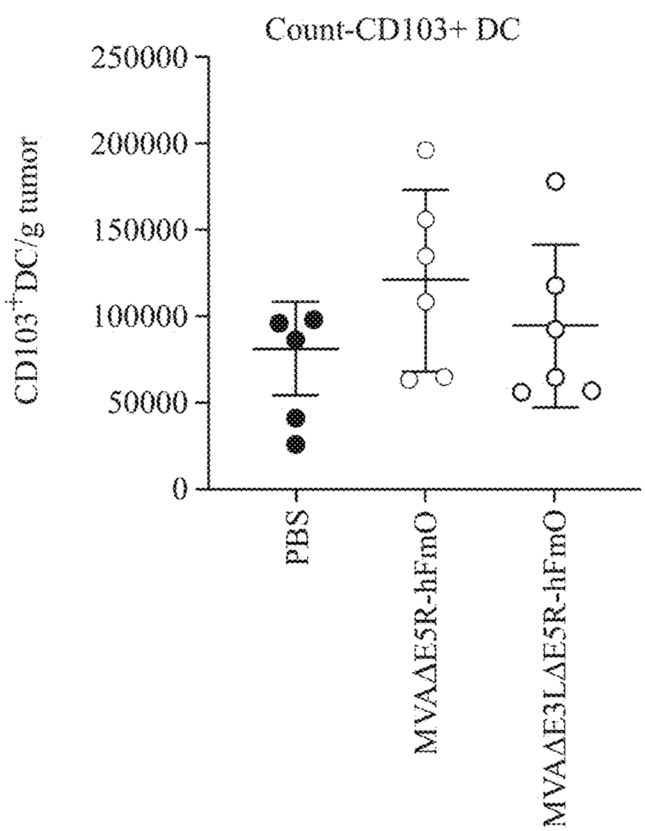

FIGS. 148A-148H are series of data showing that intratumoral injection of MVAΔE5R-hFl3L-mOX40L or MVAΔE3LΔE5R-hFl3L-mOX40L reduces the percentage of macrophages and DCs in injected tumors. FIG. 148A shows the graph of percentages of macrophages in injected tumors after treatment with either MVAΔE5R-hFl3L-mOX40L or MVAΔE3LΔE5R-hFl3L-mOX40L. Data are means ±SEM (n=4-6). FIG. 148B shows the graph of absolute number of macrophages. Data are means ±SEM (n=4-6). (P<0.01; *P<0.001, t test). FIG. 148C shows the graph of percentages of DCs. Data are means ±SEM (n=4-6). (P<0.01; *P<0.001, t test). FIG. 148D shows the graph of absolute number of DCs. Data are means ±SEM (n=4-6). (P<0.01; *P<0.001, t test). FIG. 148E shows the graph of percentages of $CD11b^+$DCs. Data are means ±SEM (n=4-6). (P<0.01; *P<0.001, t test). FIG. 148F shows the graph of absolute number of $CD11b^+$DCs. Data are means ±SEM (n=4-6). (P<0.01; *P<0.001, t test). FIG. 148G shows the graph of percentages of $CD103^+$DCs. Data are means ±SEM (n=4-6). (P<0.01; *P<0.001, t test). FIG. 148H shows the graph of absolute number of $CD103^+$DCs. Data are means ±SEM (n=4-6). (P<0.01; *P<0.001, t test).

Figure 149:
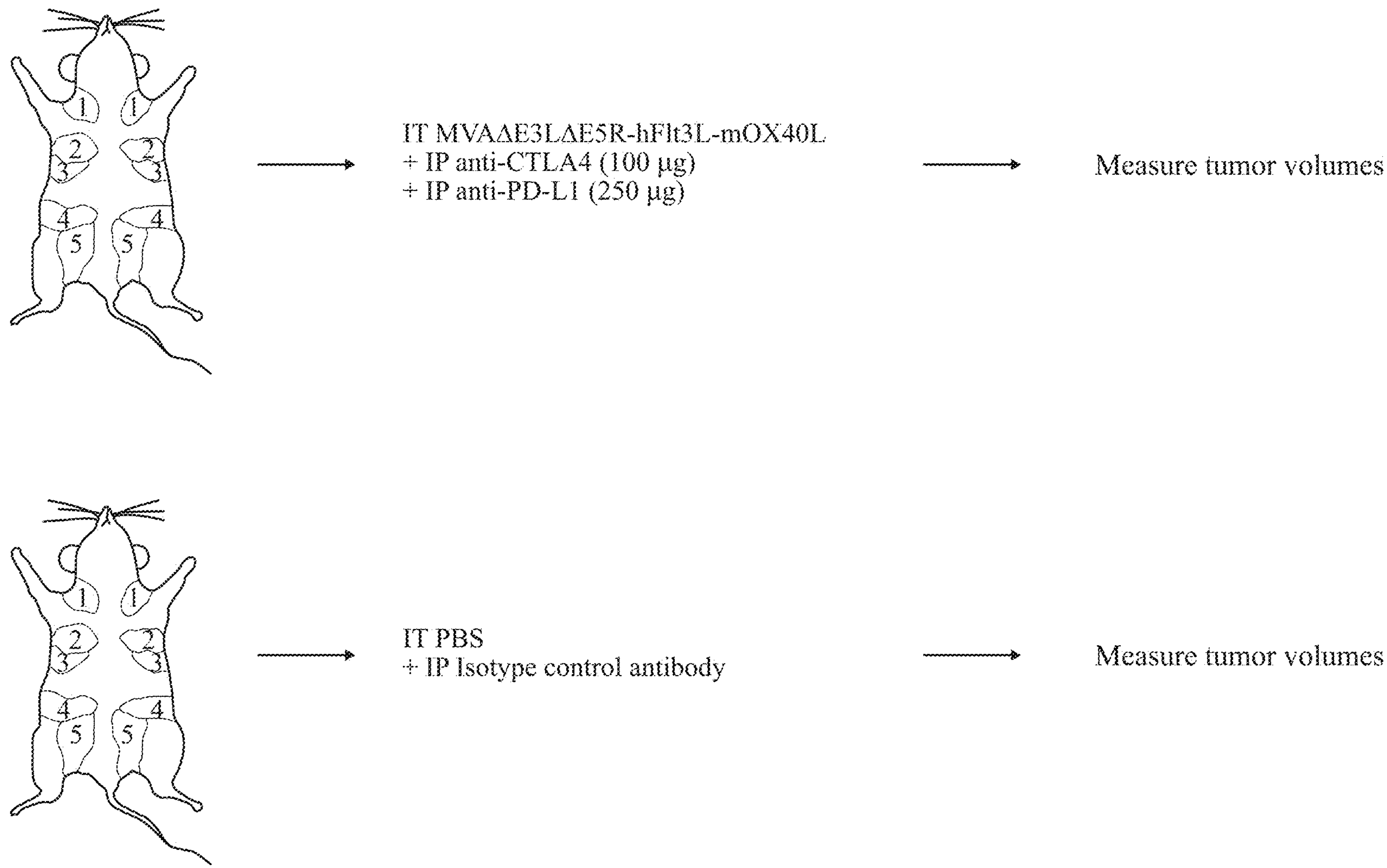
Figure 150:
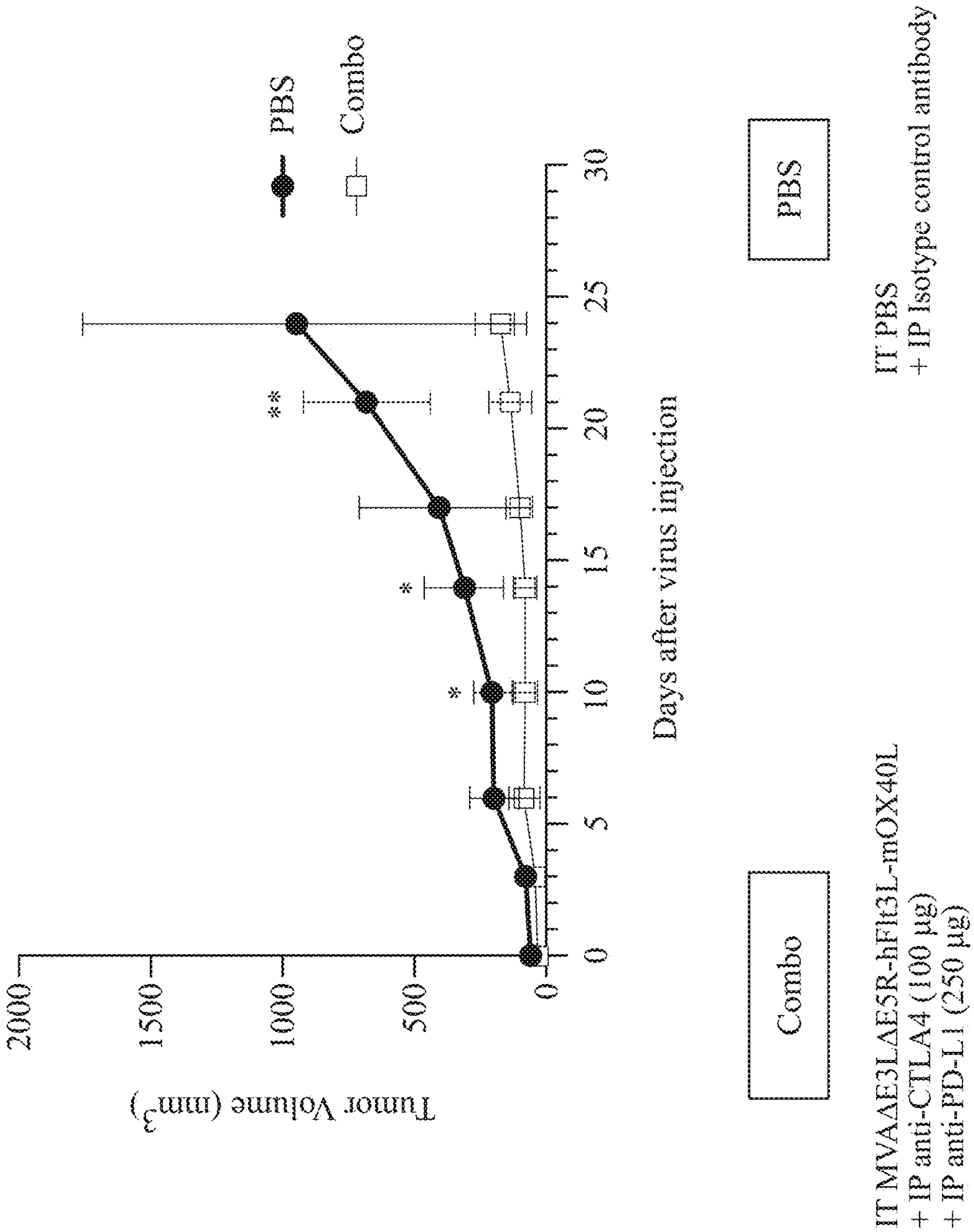

FIGS. 149-150 are a series of graphical representations of data showing that the combination of intratumoral injection of MVAΔE3LΔE5R-hFl3L-mOX40L with anti-PD-L1 and anti-CTLA-4 antibody had superior anti-tumor efficacy in MMTV-PyMT breast cancer model. FIG. 149 shows the experimental scheme. After the first tumor became palpable, $4\times10^7$ pfu of MVAΔE3LΔE5R-hFl3L-mOX40L or PBS was intratumorally (IT) injected into the tumors twice a week. 250 μg Anti-PD-L1 and 100 μg anti-CTLA-4 antibody or isotype control antibody were injected intraperitoneally to each mouse twice a week. Tumor volumes were measured twice a week. FIG. 150 shows the graph of tumor growth curve after treatment with IT MVAΔE3LΔE5R-hFl3L-mOX40L and IP anti-PD-L1 and anti-CTLA-4 antibody. Data are means ±SEM (n=3-4).

Figure 151:
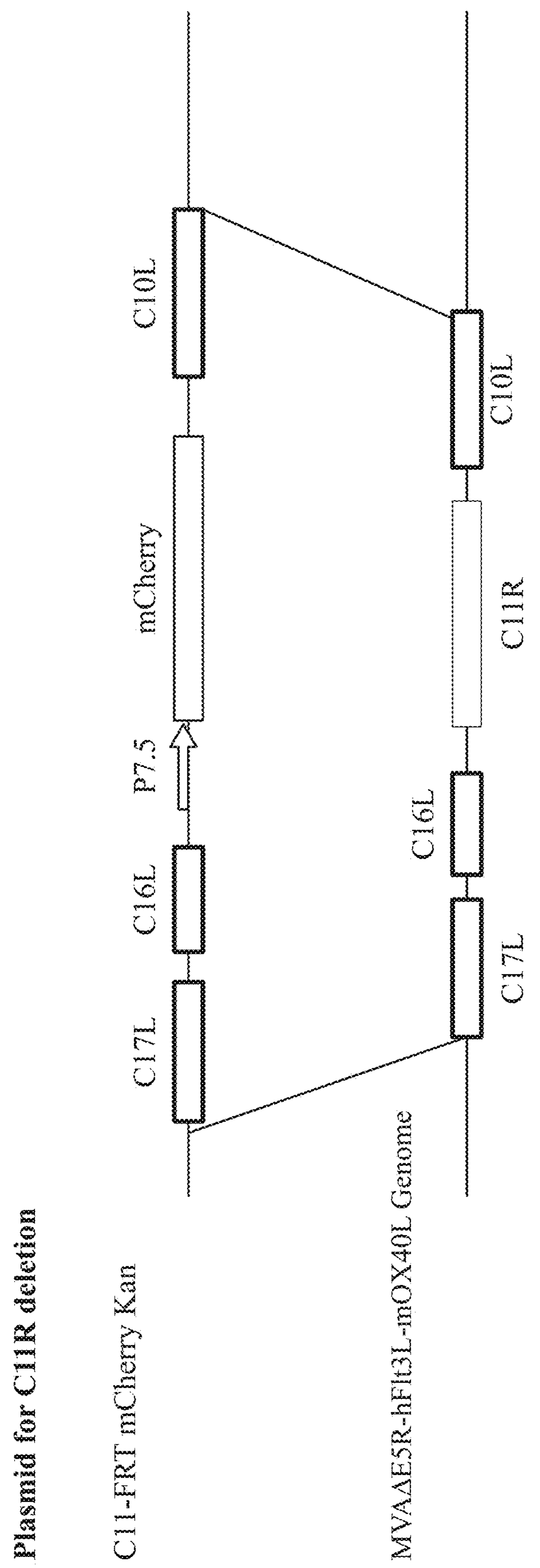
Figure 152A:
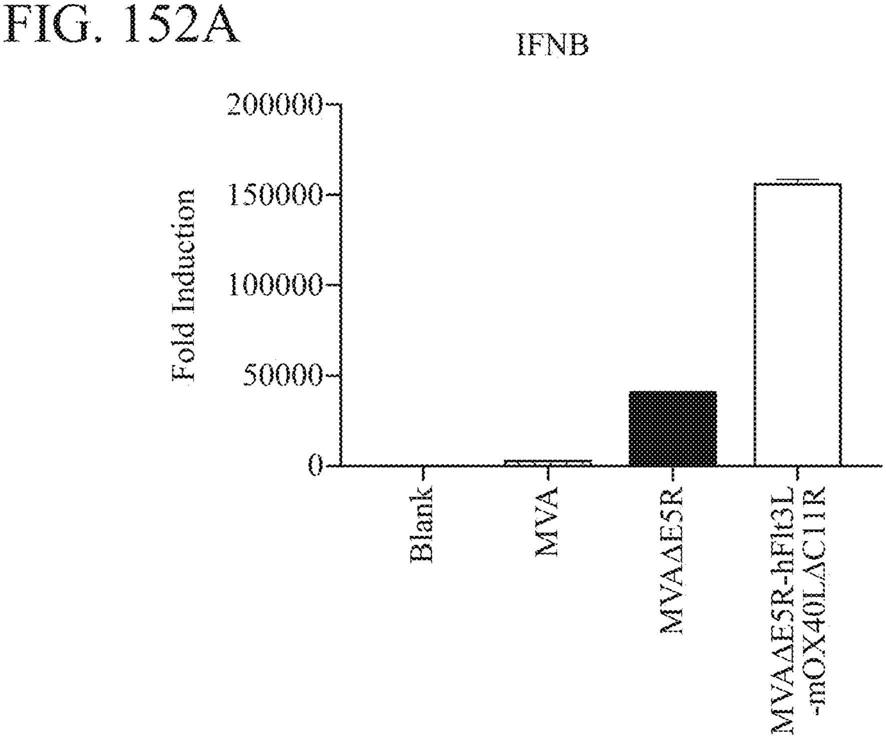
Figure 152B:
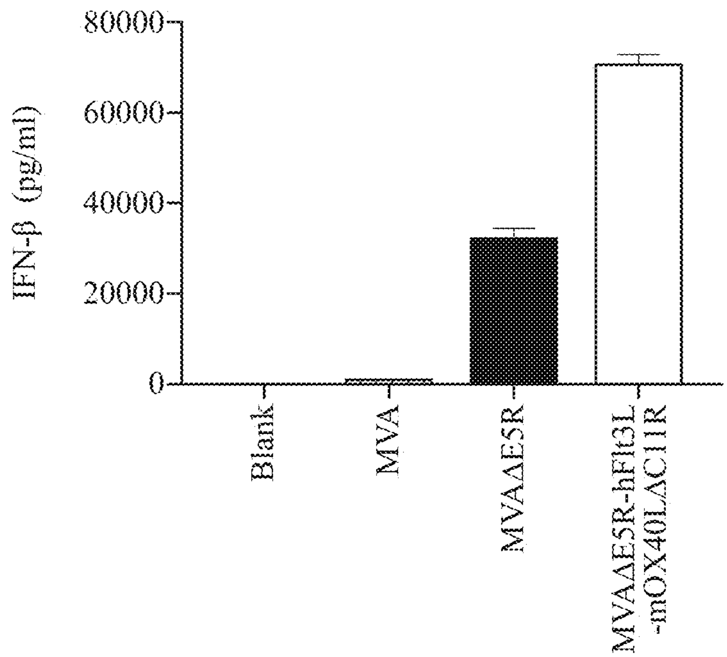

FIGS. 151-152B are a series of graphical representations of data showing that deletion of C11R gene from MVAΔE5R-hFl3L-mOX40L increases IFN production in BMDCs.

FIG. 151 is a schematic diagram of homologous recombination to generate MVAΔE5R-hFl3L-mOX40ΔC11R.

FIGS. 152A-152B show that MVAΔE5R-hFl3L-mOX40ΔC11R infection of BMDCs induces higher levels of IFNB gene expression (FIG. 152A) and protein secretion (FIG. 152B) compared with MVAΔE5R or MVA. BMDCs from WT mice were infected with MVA, MVAΔE5R, or MVAΔE5R-hFl3L-mOX40ΔC11R at a MOI of 10. For assessing IFNB gene expression, cells were collected at 6 h post infection and RNAs were extracted. Quantitative RT-PCR analyses were performed to examine the expression of IFNB gene. For testing IFN-b protein secretion from BMDCs, supernatants were collected at 19 h post infection. IFN-b protein levels were determined by ELISA.

Figure 153:
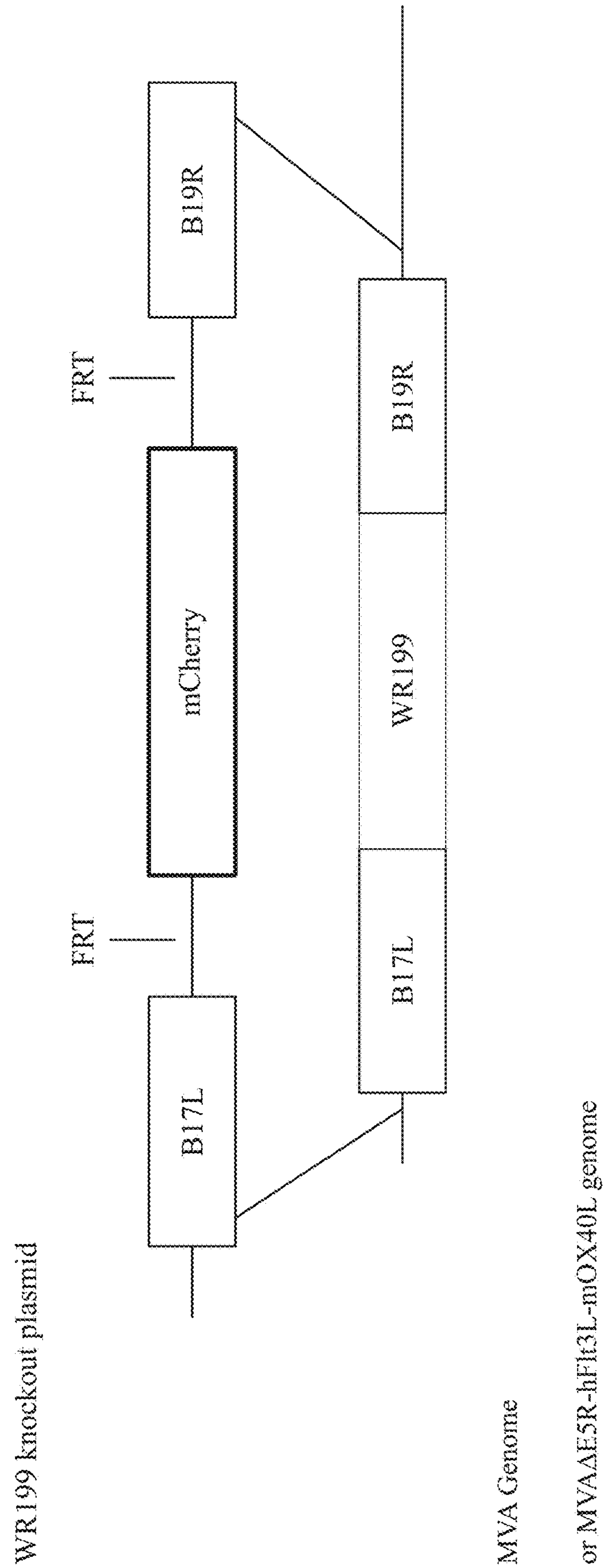
Figure 154A:
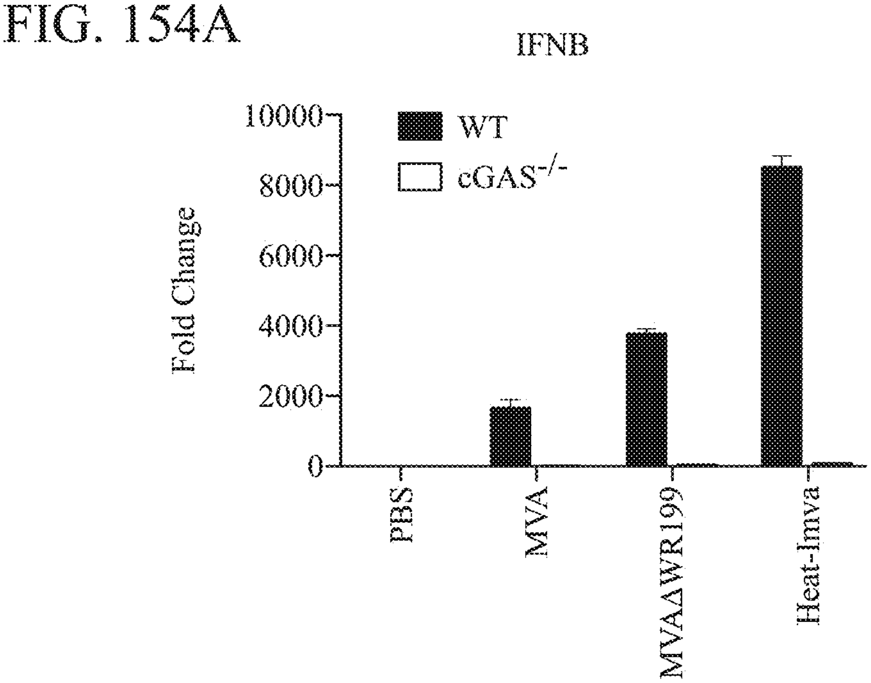
Figure 154B:
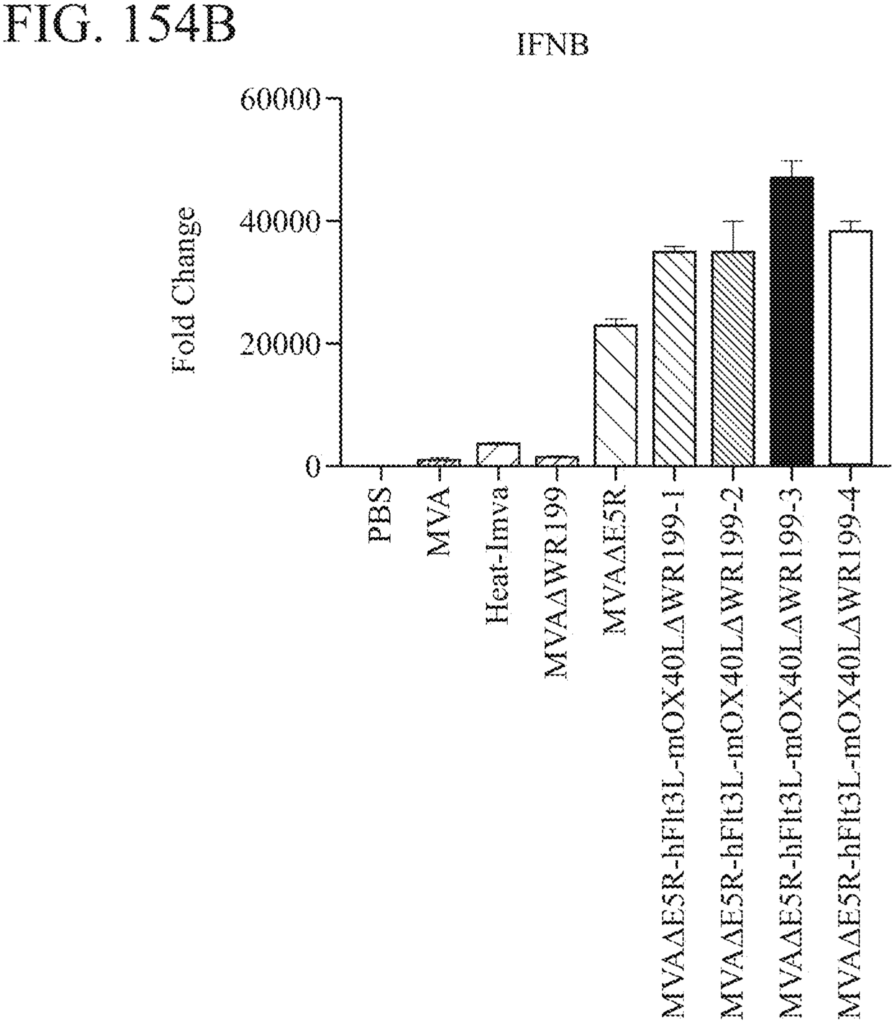
Figure 154C:
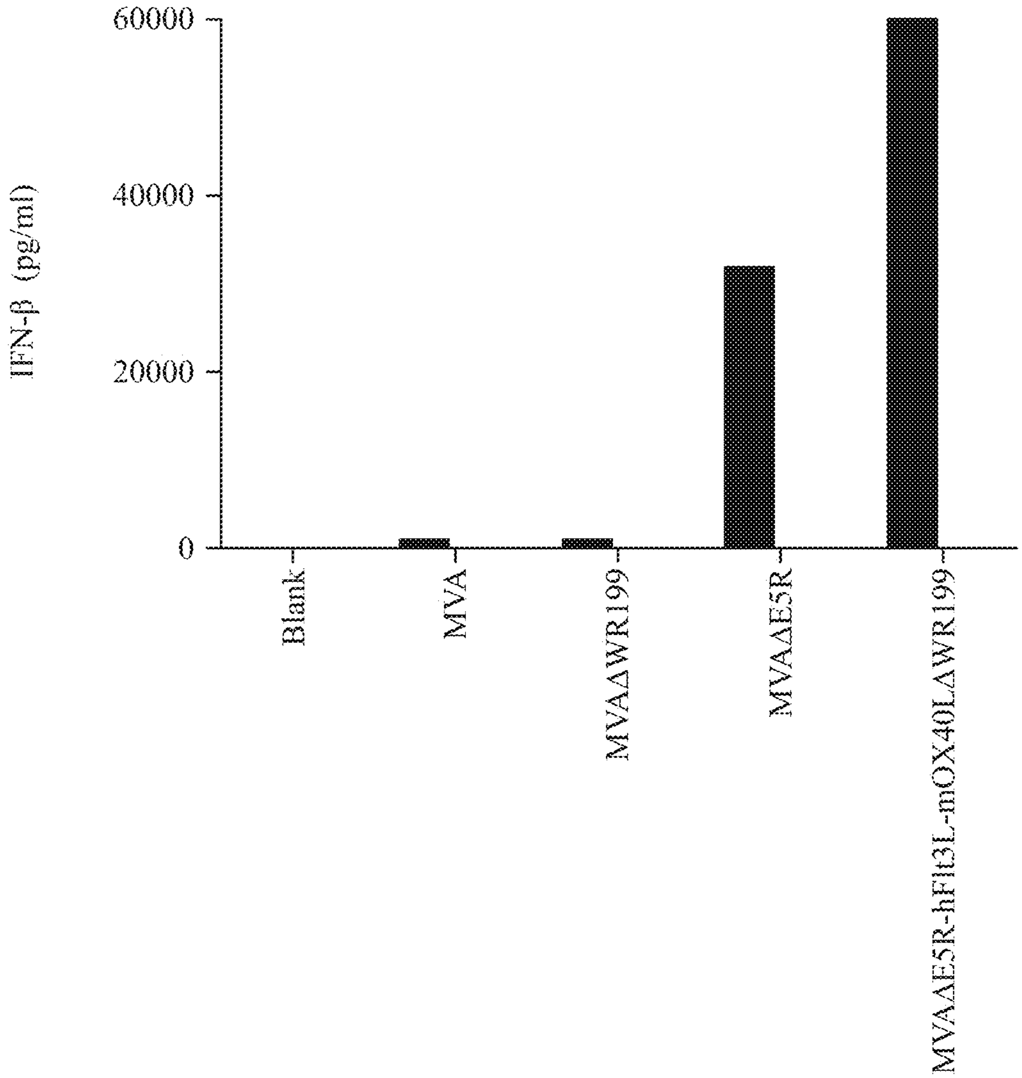

FIGS. 153-154C are a series of graphical representations of data showing that deletion of WR199 gene from MVA or MVAΔE5R-hFl3L-mOX40L increases IFN production in BMDCs.

FIG. 153 is a schematic diagram of homologous recombination to generate MVAΔE5R-hFl3L-mOX40ΔWR199. Homologous recombination that occurred at the B17L and B19R loci results in the deletion of WR199 and the insertion of expression cassette for mcherry flanked by two FRT sites.

FIG. 154A shows the IFNB gene expression in PBS, MVA, MVAΔWR199, or Heat-iMVA infected BMDCs from WT or $cGAS^{-/-}$ mice at a MOI of 10. FIGS. 154B-154C shows that MVAΔE5R-hFl3L-mOX40ΔC11R infection of BMDCs induces higher levels of IFNB gene expression (FIG. 154B) and protein secretion (FIG. 154C) compared with MVAΔE5R or MVA. BMDCs from WT mice were infected with MVA, MVAΔE5R, or MVAΔE5R-hFl3L-mOX40ΔC11R at a MOI of 10. For assessing IFNB gene expression, cells were collected at 6 h post infection and RNAs were extracted. Quantitative RT-PCR analyses were performed to examine the expression of IFNB gene. For testing IFN-β protein secretion from BMDCs, supernatants were collected at 19 h post infection. IFN-β protein levels were determined by ELISA.

Figure 155:
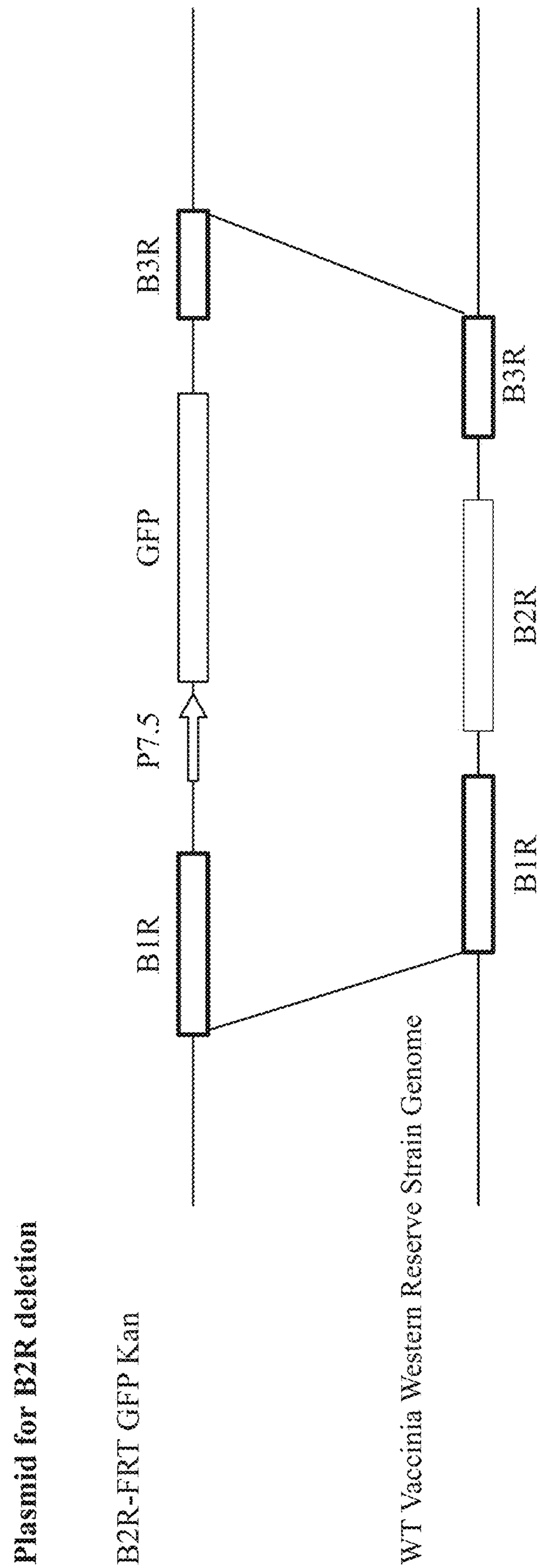

FIG. 155 shows a scheme of generating recombinant VACVΔB2R virus through homologous recombination at the BIR and B3R loci of the vaccinia virus (WR) genome. Homologous recombination that occurred at the BIR and B3R loci results in the deletion of B2R gene from the vaccinia virus (WR) genome.

Figure 156A:
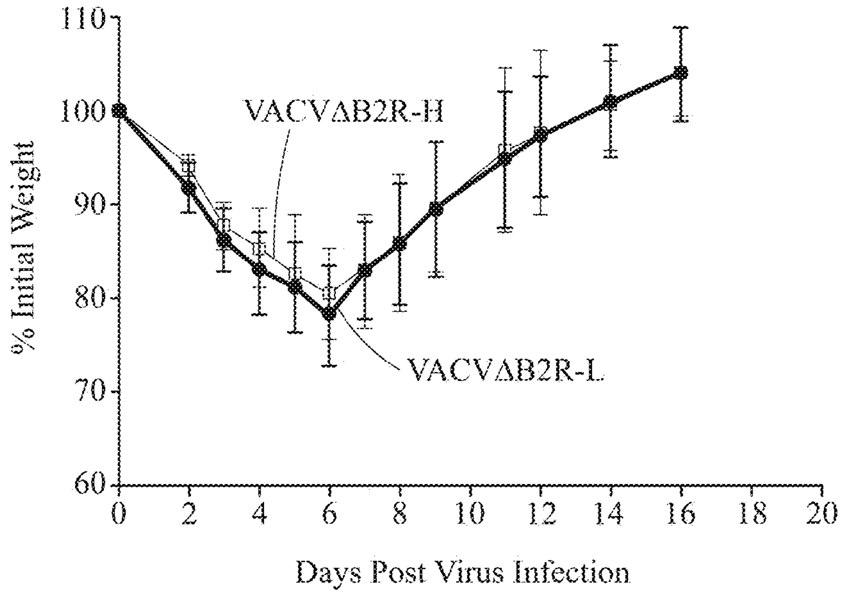
Figure 156B:
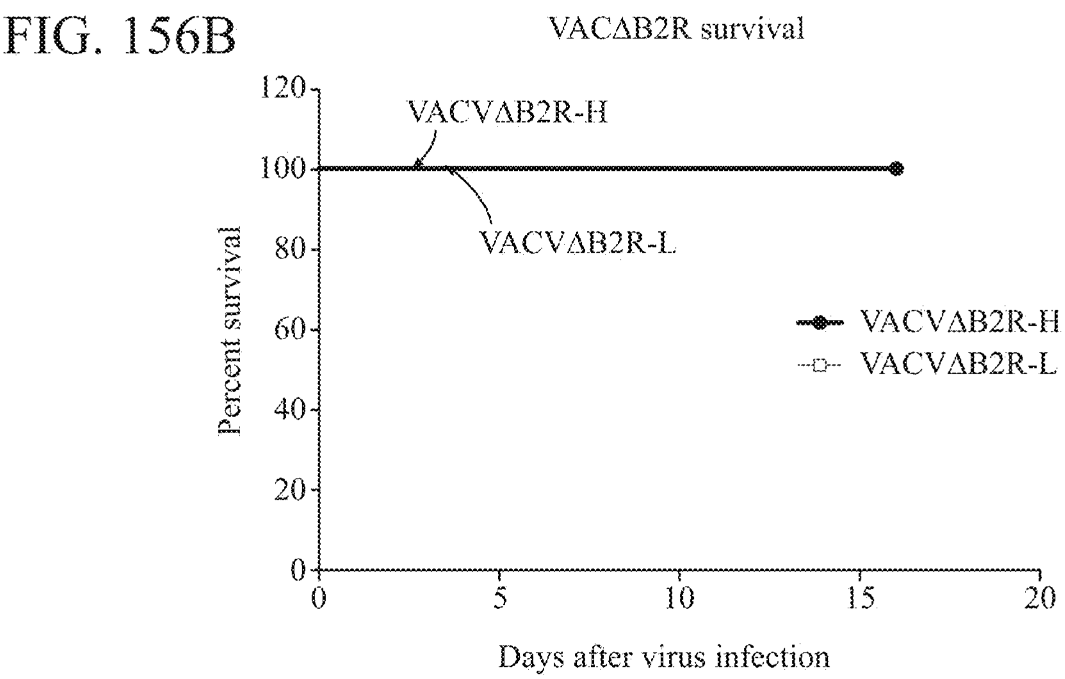

FIGS. 156A-156B show that VACVΔB2R was highly attenuated in an intranasal infection model. FIG. 156A shows the weight loss after intranasal infection with either high dose of VACVΔB2R (H, $2\times10^7$ pfu), or low dose of VACVΔB2R (L, $2\times10^6$ pfu). FIG. 156B shows the Kaplan-Meier survival curves of intranasal infected mice with high dose of VACVΔB2R (H, $2\times10^7$ pfu) or low dose of VACVΔB2R (L, $2\times10^6$ pfu).

Figure 157A:
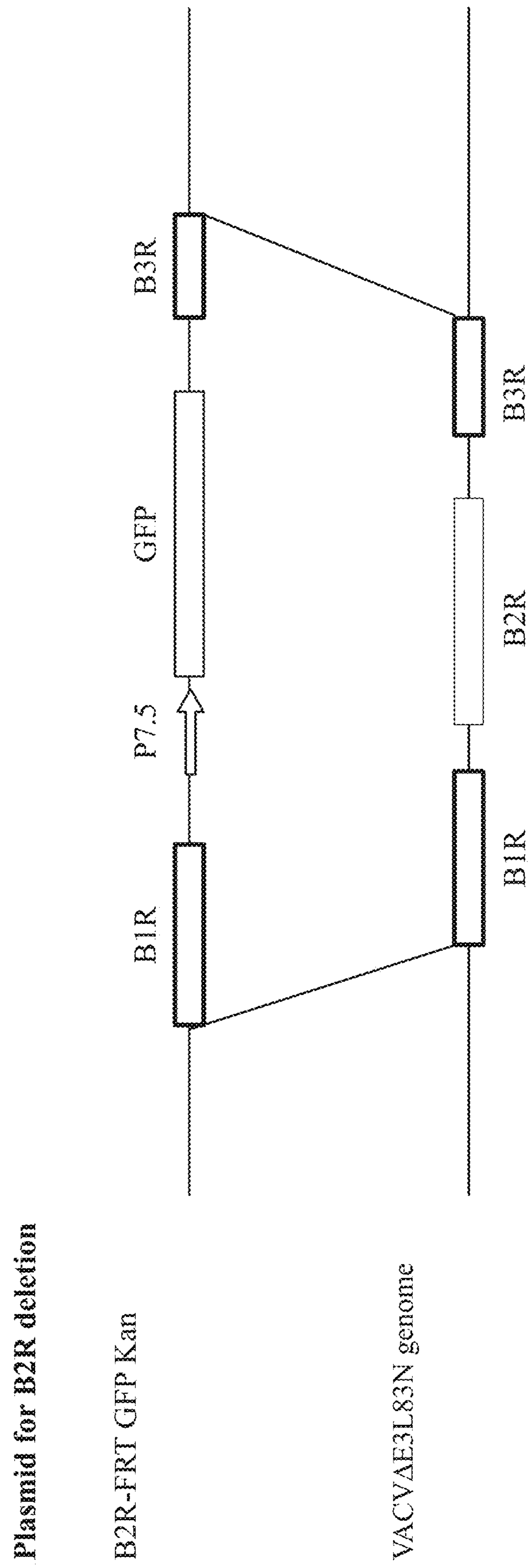
Figure 157B:
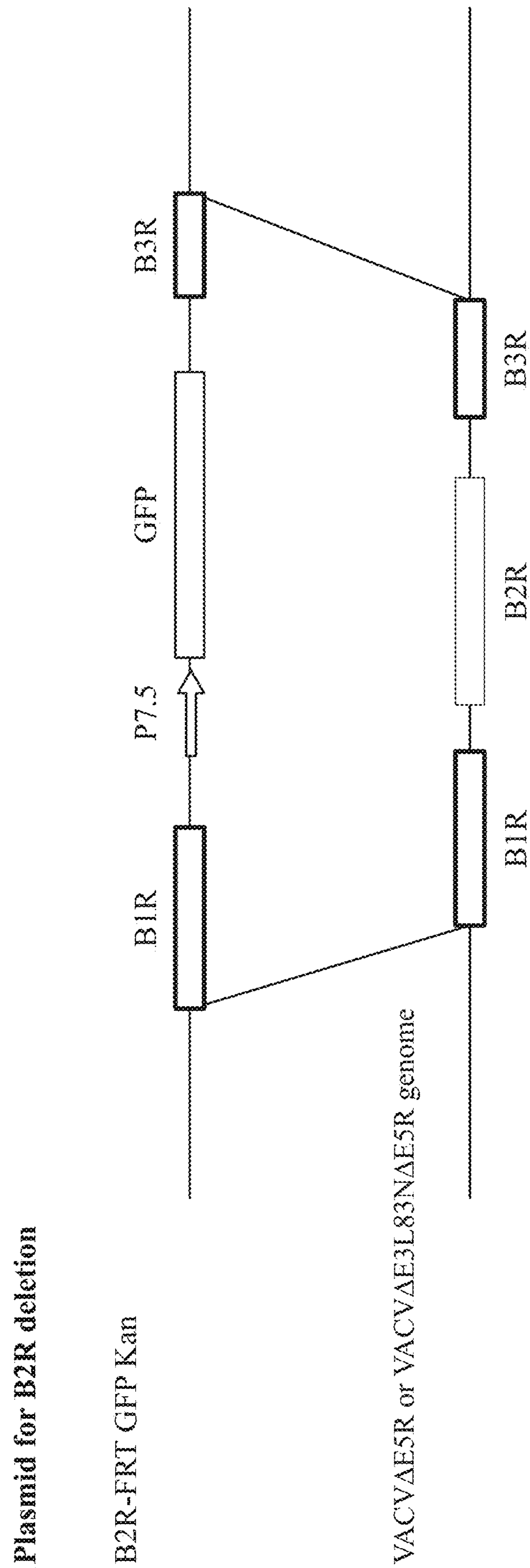

FIGS. 157A-157B shows a schematic diagrams of generating recombinant VACVΔE3L83NΔB2R, VACVΔE5RΔB2R, and VACVΔE3L83NΔE5RΔB2R viruses. FIG. 157A shows that VACVΔE3L83NΔB2R was generated through homologous recombination at the B1R and B3R loci of the vaccinia VACVΔE3L83N genome, resulting in the deletion of B2R gene from the VACVΔE3L83N genome. FIG. 157B shows that VACVΔE5RΔB2R and VACVΔE3L83NΔE5RΔB2R are generated through homologous recombination at the B1R and B3R loci of the vaccinia VACVΔE5R or VACVΔE3L83NΔE5R genome, respectively. Homologous recombination that occurred at the B1R and B3R loci results in the deletion of B2R gene from the VACVΔE5R or VACVΔE3L83NΔE5R genome, respectively.

Figure 158:
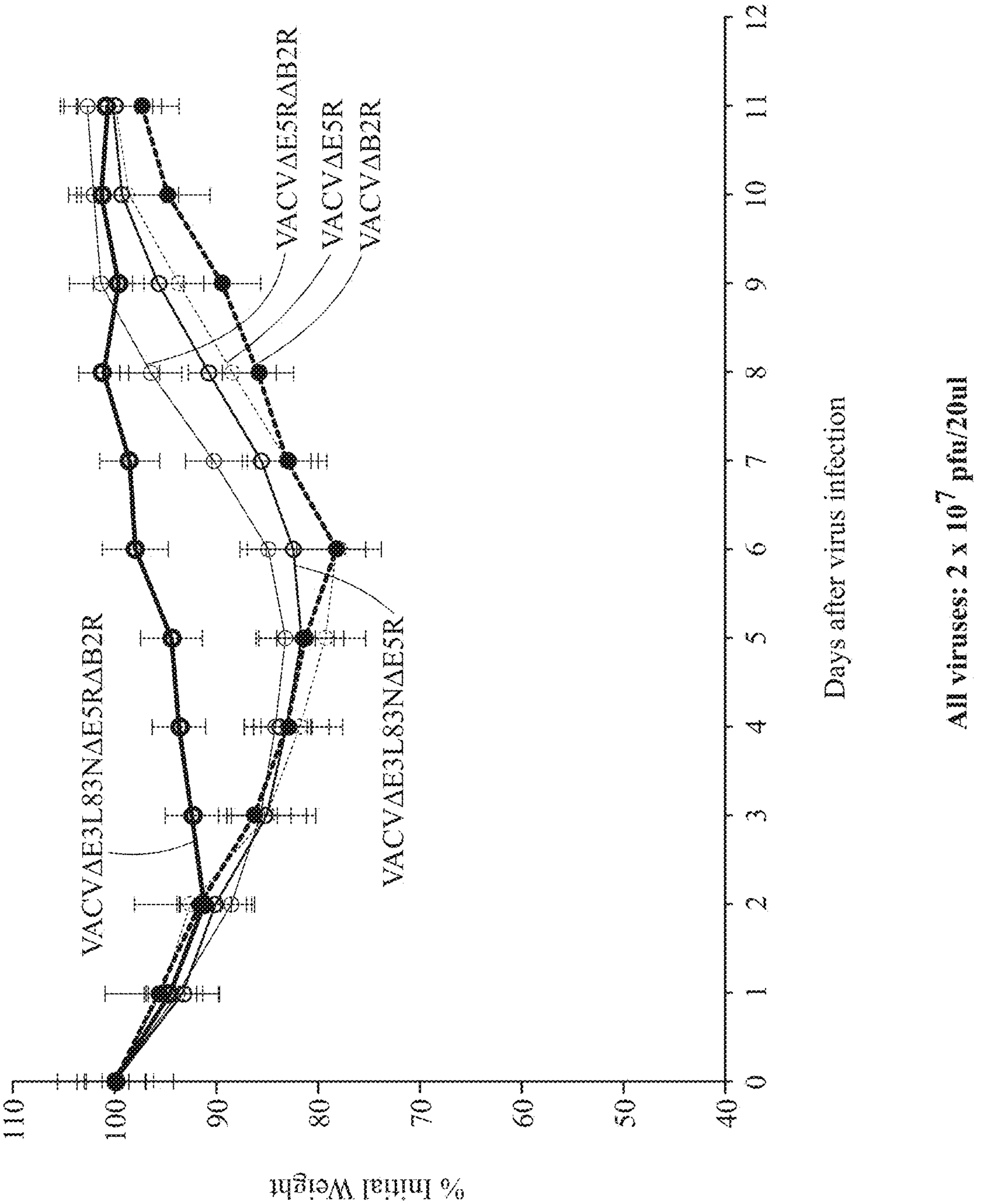

FIG. 158 shows that VACVΔE3L83NΔE5R, VACVΔE5RΔB2R, and VACVΔE3L83NΔE5RΔB2R are highly attenuated in an intranasal infection model. WT mice were intranasally infected with $2\times10^7$ pfu of VACVΔB2R, VACVΔE5R, VACVΔE3L83NΔE5R, VACVΔE5RΔB2R, or VACVΔE3L83NΔE5RΔB2R, and survival and weight loss were monitored daily. This figure shows weight loss after intranasal infection with these five different viruses.

Figure 159A:
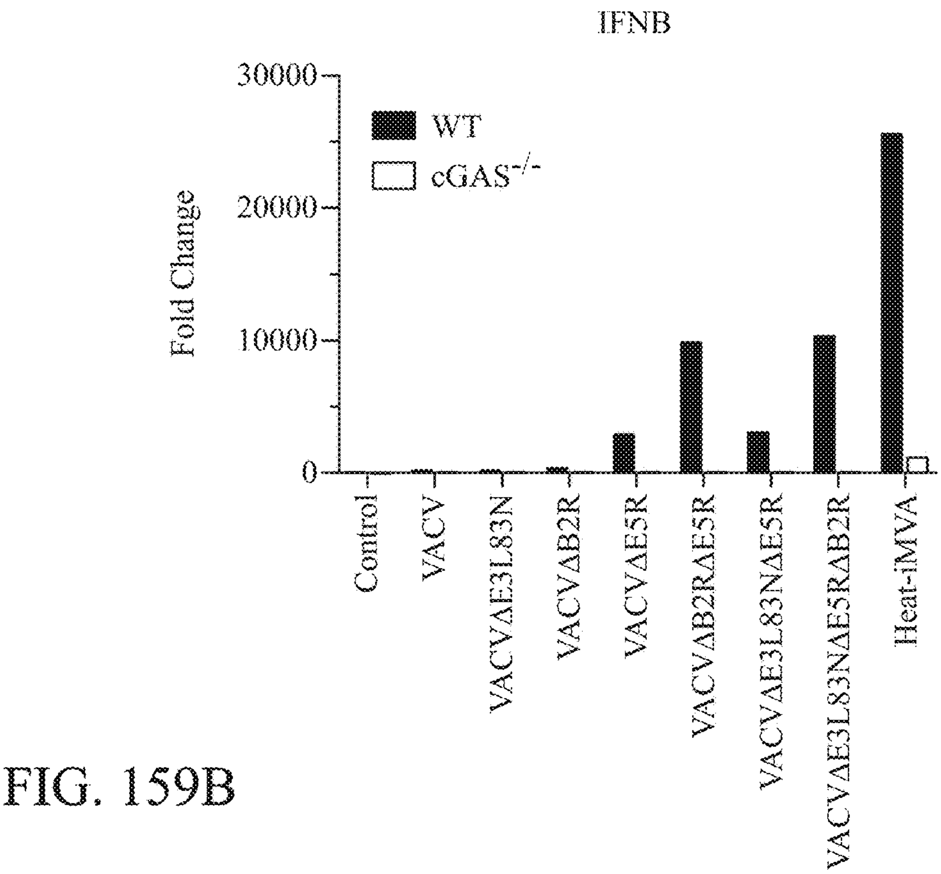
Figure 159B:
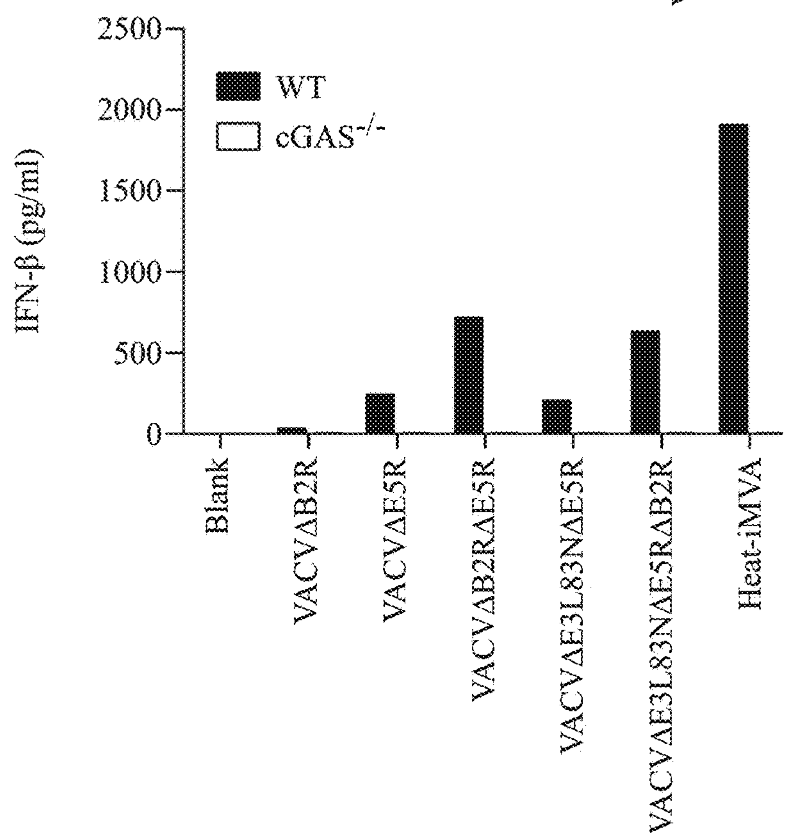

FIGS. 159A-159B shows that VACVΔE5RΔB2R and VACVΔE3L83NΔE5RΔB2R infection of murine BMDC induce higher levels of IFNB gene expression and IFN-γ protein secretion compared with. VACVΔB2R or VACVΔE5R. FIG. 159A shows the IFNB gene expression in WT and cGAS knockout BMDC cells infected with VACV, VACVΔ83N, VACVΔB2R, VACVΔE5R, VACVΔE5RΔB2R, VACVΔE3L83NΔE5R, or VACVΔE3L83NΔE5RΔB2R at a MOI of 10. Cells were collected at 6 hours post infection and RNAs were extracted. Quantitative RT-PCR analyses were performed to examine the expression of IFNB gene. FIG. 159B shows the IFN-γ protein secretion by WT and cGAS knockout BMDC cells infected with VACV, VACVΔ83N, VACVΔB2R, VACVΔE5R, VACVΔE5RΔB2R, VACVΔE3L83NΔE5R, or VACVΔE3L83NΔE5RΔB2R at a MOI of 10. Supernatants were collected at 24 h post infection and IFN-γ protein levels in the supernatants were determined by ELISA.

Figure 160:
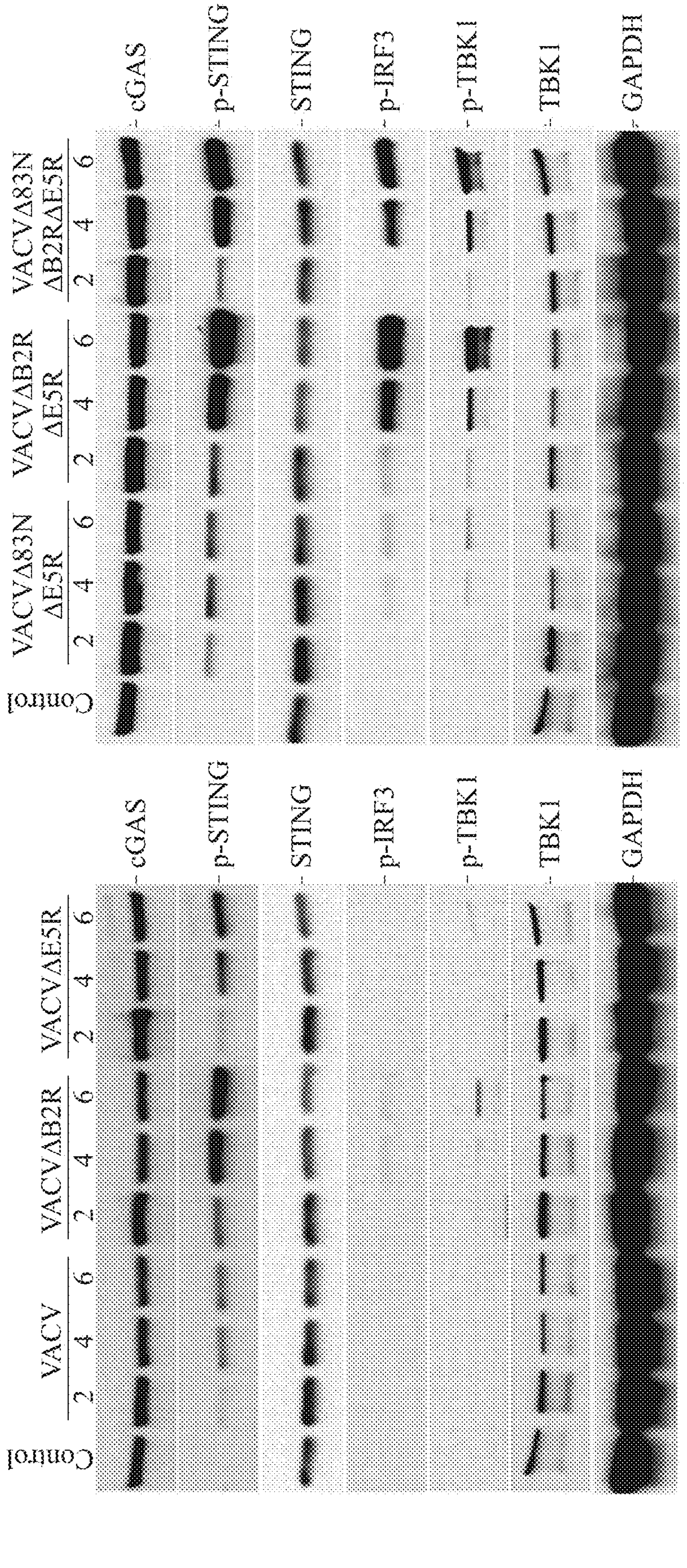

FIG. 160 shows that VACVΔE5RΔB2R and VACVΔE3L83NΔE5RΔB2R infection of murine BMDC induce higher levels of phosphorylation of STING, IRF3 and TBK1 compared with VACVΔB2R or VACVΔE5R. WT BMDC cells were infected with VACV, VACVΔB2R, VACVΔE5R, VACVΔE5RΔB2R, VACVΔE3L83NΔE5R, or VACVΔE3L83NΔE5RΔB2R at a MOI of 10. Cell lysis were collected at different time points. The phosphorylation of STING, IRF3,and TBK1 were detected by antibodies against phosphorylated STING, IRF3,and TBK1,respectively.

Figure 161:
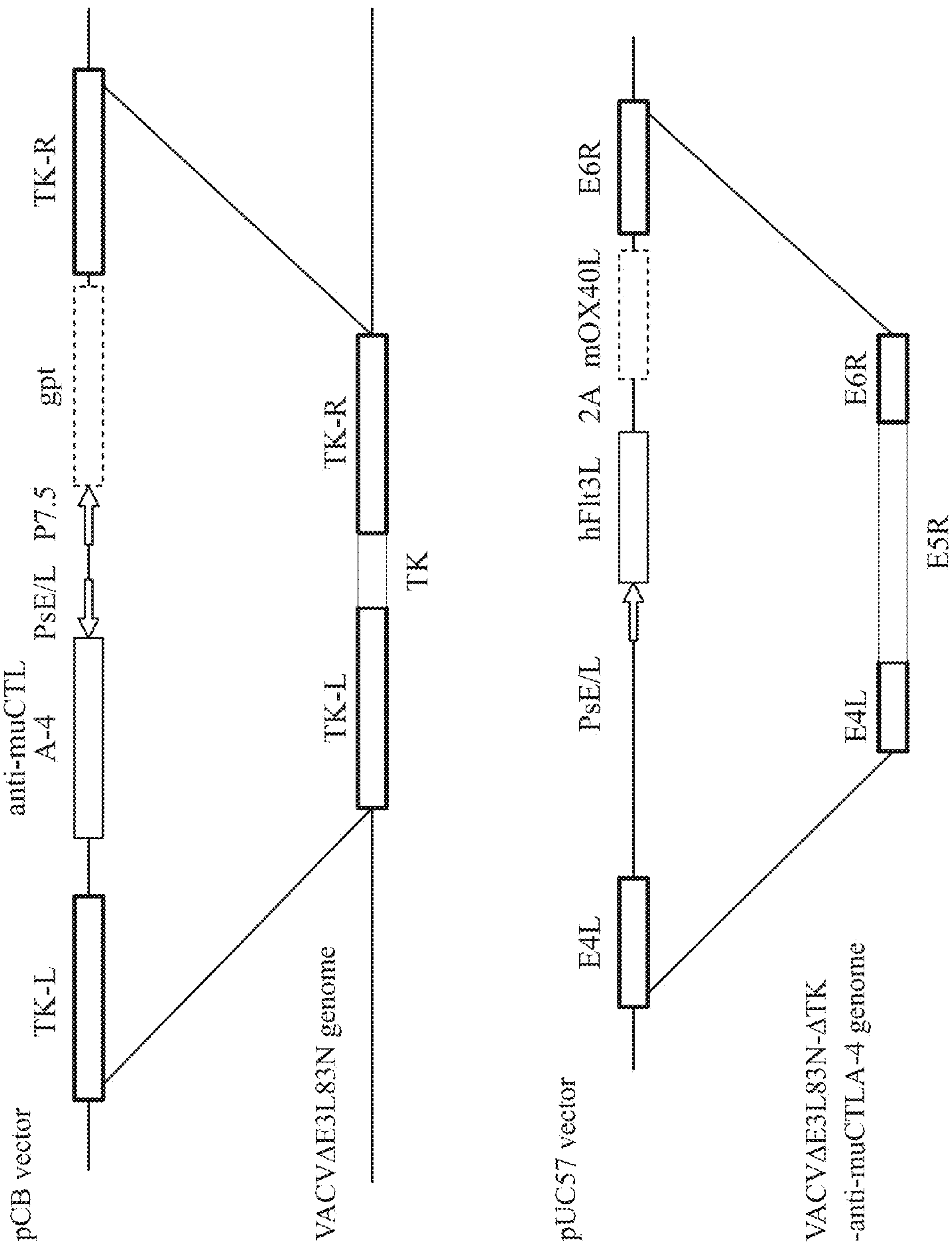

FIG. 161 shows a scheme of stepwise strategy to generate recombinant VACVΔE3L83NΔTKΔE5R virus expressing anti-muCTLA-4 antibody, and hFl3L, mOX40L and mIL12 proteins through homologous recombination first at the TK and then at the E5R loci of the VACVΔE3L83N genome. pCB vector was used to insert a single expression cassette to express the anti-muCTLA-4 antibody heavy and light chains under the control of the vaccinia virus synthetic early and late promoter (PsE/L). Homologous recombination that occurred at the TK-L and TK-R sites results in the insertion of expression cassette of anti-muCTLA-4 antibody into TK locus on VACVΔE3L83N genome. pUC57 vector was used to insert two expression cassettes designed to express both hFl3L-mOX40L fusion protein and mIL-12 using the vaccinia viral synthetic early and late promoter (PsE/L). The coding sequence of the hFl3L-mOX40L was separated by a furin cleavage site followed by a Pep2A sequence. The coding sequence of p40 and p30 subunits of mIL12 was separated by a furin cleavage site followed by a Pep2A sequence. The C-terminus of p30 subunit was tagged with a matrix binding sequence. Homologous recombination at the E4L and E6R loci results in the insertion of expression cassette for hFl3L-mOX40L and mIL12 into the E5L locus of VACVΔE3L83N-ΔTK-anti-muCTLA-4 genome.

Figure 162:
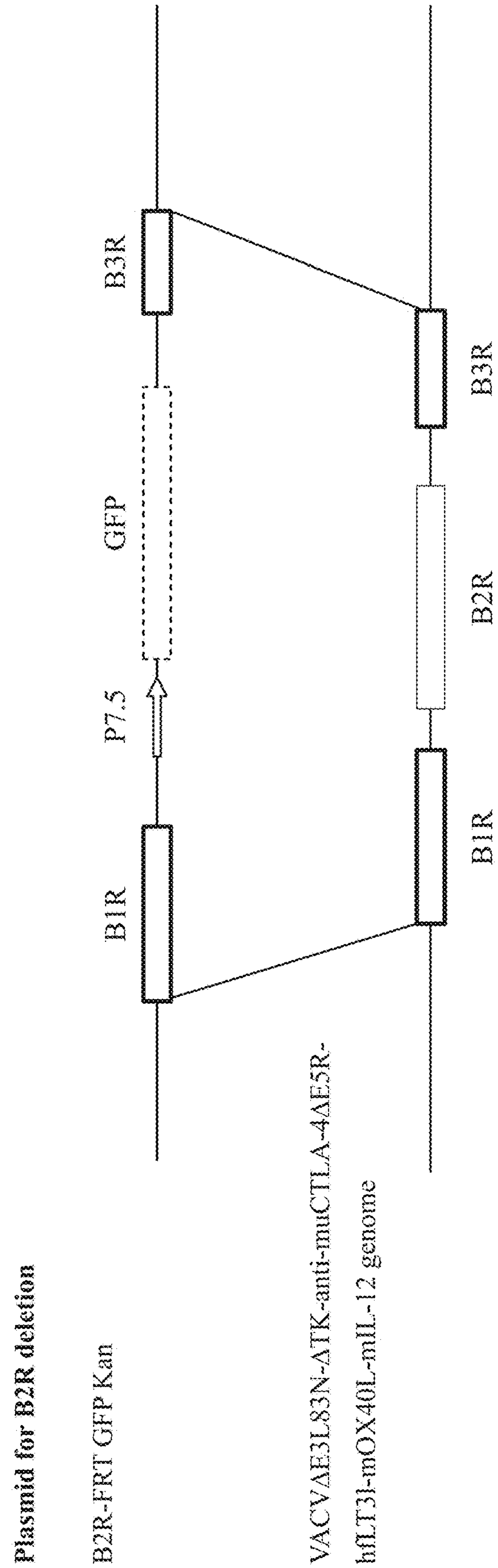

FIG. 162 shows a scheme of generating recombinant VACVΔE3L83N-ΔTK-anti-muCTLA-4-ΔE5R-hFl3L-mOX40L-mIL-12 virus with deletion of B2R gene through homologous recombination at the B1R and B3R loci of the VACVΔE3L83N-ΔTK-anti-muCTLA-4-ΔE5R-hFl3L-mOX40L-mIL-12 (OV-VACVΔE5R) genome. Homologous recombination that occurred at the B1R and B3R loci results in the deletion of B2R gene from the virus genome to generate the VACVΔE3L83N-ΔTK-anti-muCTLA-4ΔE5R-hFl3L-mOX40L-mIL-12-ΔB2R virus (OV-VACVΔE5RΔB2R).

Figure 163:
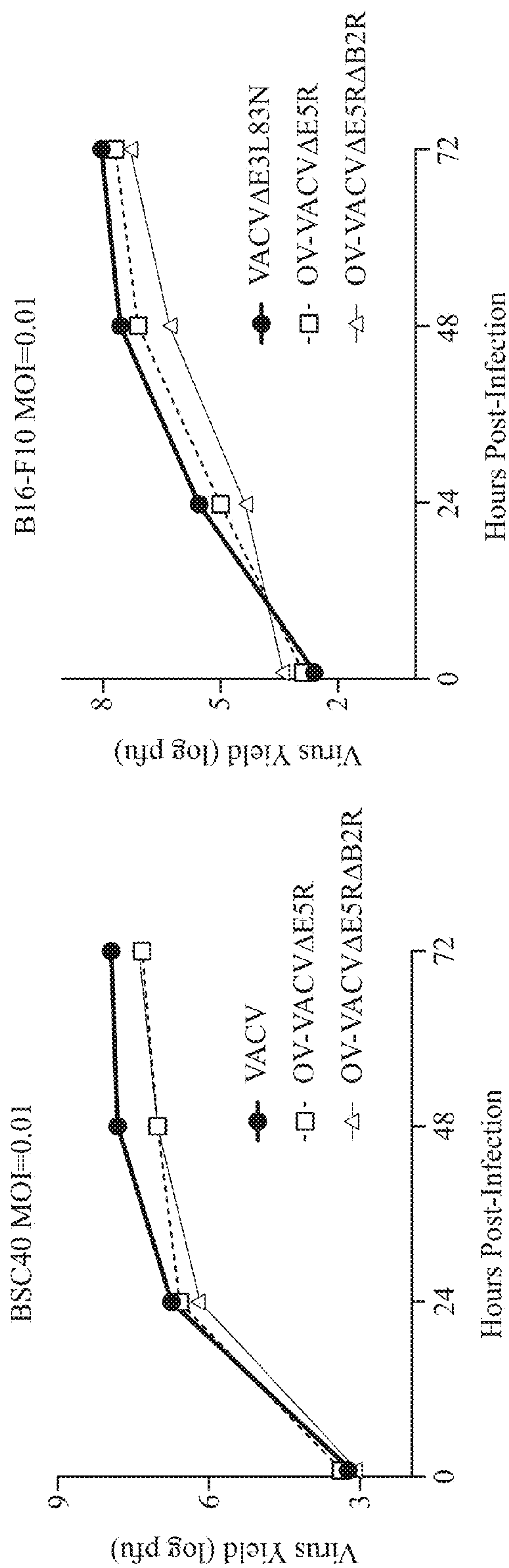

FIG. 163 shows a multistep growth curve of the recombinant viruses VACVΔE3L83N-ΔTK-anti-muCTLA-4ΔE5R-hFl3L-mOX40L-mIL-12 (OV-VACVΔE5R) and VACVΔE3L83N-ΔTK-anti-muCTLA-4ΔE5R-hFl3L-mOX40L-mIL-12-ΔB2R (OV-VACVΔE5RΔB2R) in BSC40 cells compared with WT VACV. BSC40 cells were infected with VACV, VACVΔE3L83N-ΔTK-anti-muCTLA-4ΔE5R-hFl3L-mOX40L-mIL-12, and VACVΔE3L83N-ΔTK-anti-muCTLA-4ΔE5R-hFl3L-mOX40L-mIL-12-ΔB2R at a MOI of 0.01. Virus samples were collected at different time points and virus titers were determined using BSC40 cells.

Figure 164A:
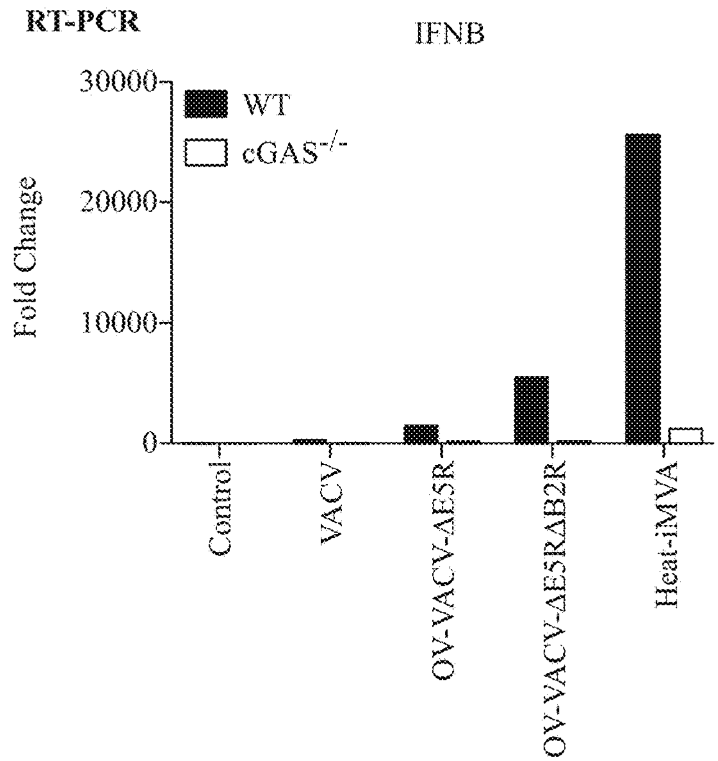
Figure 164B:
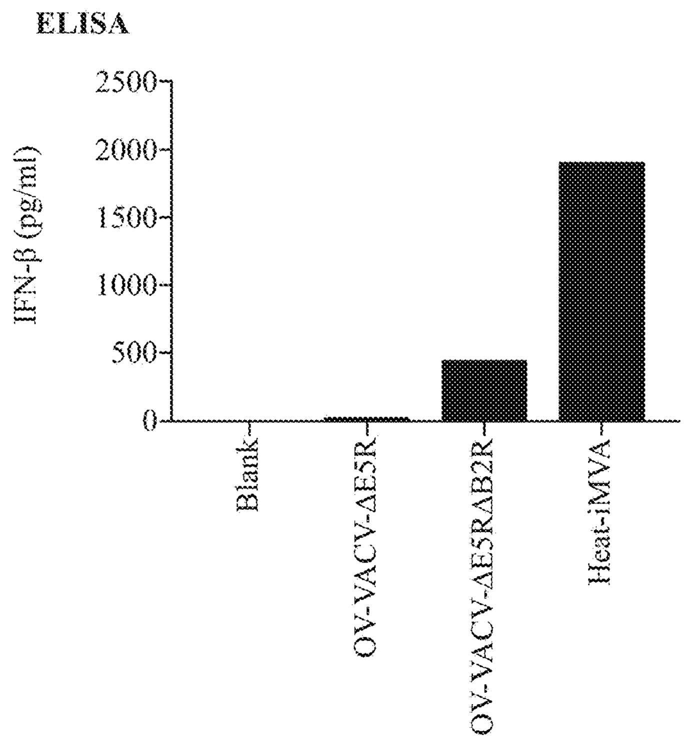

FIGS. 164A-164B shows that VACVΔE3L83N-ΔTK-anti-muCTLA-4ΔE5R-hFl3L-mOX40L-mIL-12-ΔB2R (OV-VACVΔE5RΔB2R) infection of murine BMDC induce higher levels of IFNB gene expression and IFN-γ protein secretion compared with VACVΔE3L83N-ΔTK-anti-muCTLA-4ΔE5R-hFl3L-mOX40L-mIL-12 (OV-VACVΔE5R). FIG. 164A shows the IFNB gene expression in WT BMDC cells infected with VACVΔE3L83N-ΔTK-anti-muCTLA-4ΔE5R-hFl3L-mOX40L-mIL-12, VACVΔE3L83N-ΔTK-anti-muCTLA-4ΔE5R-hFl3L-mOX40L-mIL-12-ΔB2R, or Heat-iMVA at a MOI of 10. Cells were collected at 6 hours post infection and RNAs were extracted. Quantitative RT-PCR analyses were performed to examine the expression of IFNB gene. FIG. 164B shows the IFN-γ protein secretion in same infection as in FIG. 164A. Supernatants were collected at 24 h post infection and IFN-γ protein levels in the supernatants were determined by ELISA.

Figure 165A:
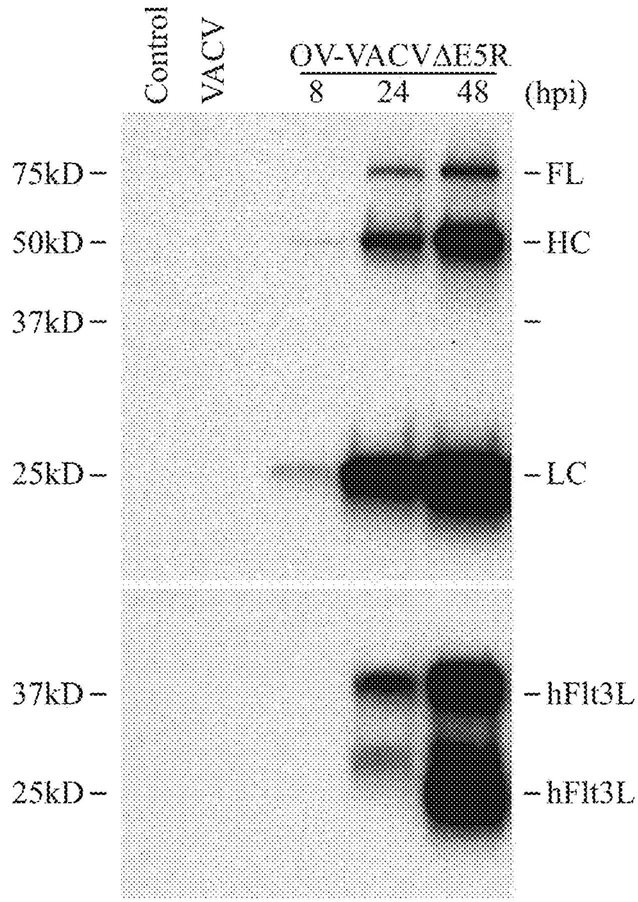
Figure 165B:
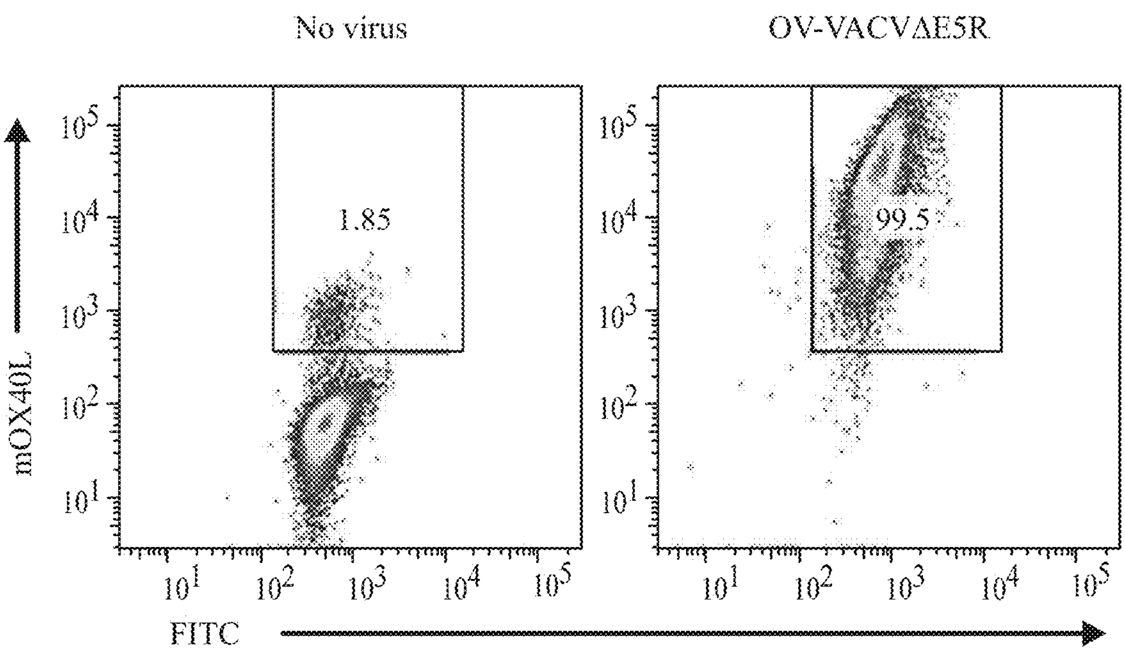
Figure 165C:
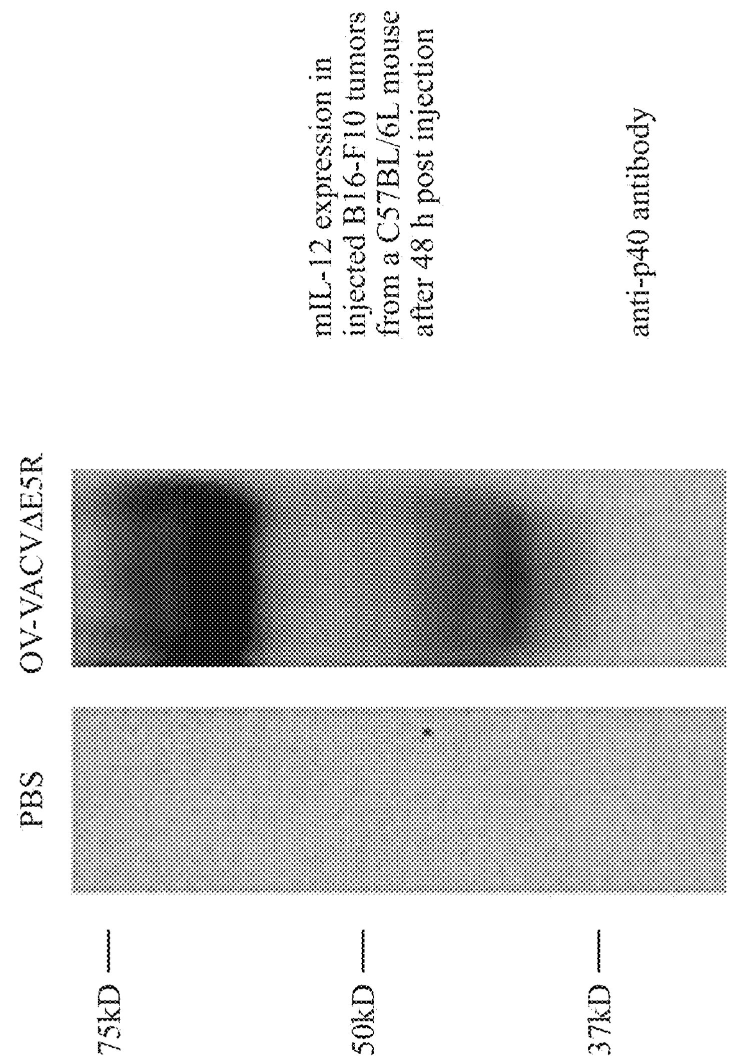

FIGS. 165A-165C show the expression of the transgenes anti-muCTLA-4, mOX40L, or human Flt3L in VACVΔE3L83N-ΔTK-anti-muCTLA-4-ΔE5R-hFl3L-mOX40L-mIL-12 (OV-VACVΔE5R) infected B16-F10 cells and in tumors injected with virus. FIG. 165A shows a western blot demonstrating that murine anti-CTLA-4 and human Flt3L are expressed in VACVΔE3L83N-ΔTK-anti-muCTLA-4-ΔE5R-hFl3L-mOX40L-mIL-12 (OV-VACVΔE5R)-infected B16-F10 cells. FL: full length of anti-muCTLA-4; HC: heavy chain of anti-muCTLA-4; LC: light chain of anti-muCTLA-4. FIG. 165B shows a dot plot of FACS analysis of mOX40 expression on murine melanoma cells B16-F10. Cells were infected with VACVΔE3L83N-ΔTK-anti-muCTLA-4-ΔE5R-hFl3L-mOX40L-mIL-12 (expressing GFP) at a MOI of 10 for 24 h. No virus mock infection control was included. Cells were stained with anti-mOX40L antibody. FIG. 165C shows the mIL-12 expression in B16-F10 melanoma tumors after intratumoral injection of VACVΔE3L83N-ΔTK-anti-muCTLA-4-ΔE5R-hFl3L-mOX40L-mIL-12 (OV-VACVΔE5R) virus. Intradermally implanted B16-F10 melanoma tumors were injected with $4\times10^7$ pfu of VACVΔE3L83N-ΔTK-anti-muCTLA-4-ΔE5R-hFl3L-mOX40L-mIL-12 (OV-VACVΔE5R) in 100 μl of PBS, and tumors were collected at 48 hours after treatment. Tumor samples were lysed and the expression of murine IL-12 were examined by western blot using anti-p40 antibody.

Figure 166A:
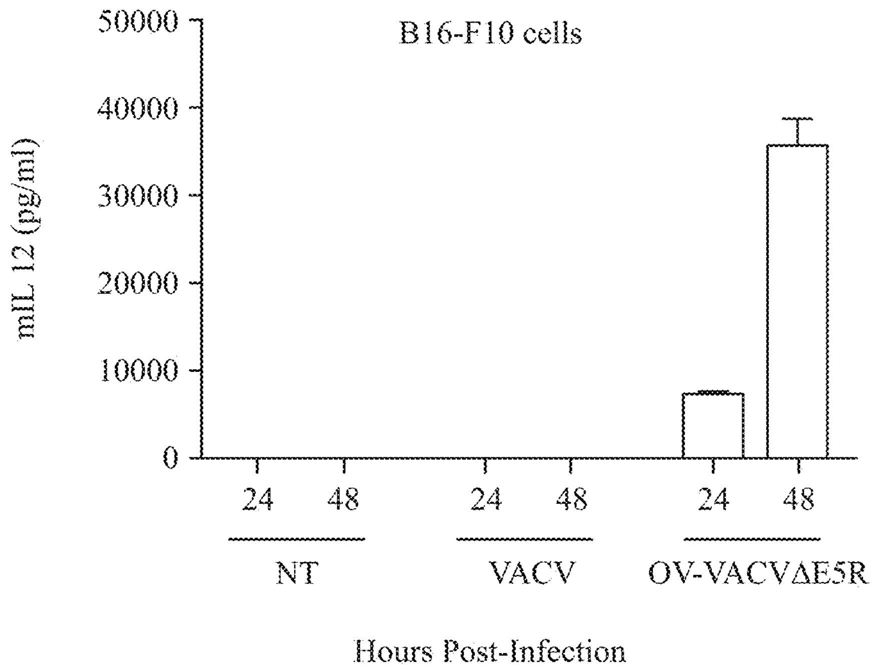
Figure 166B:
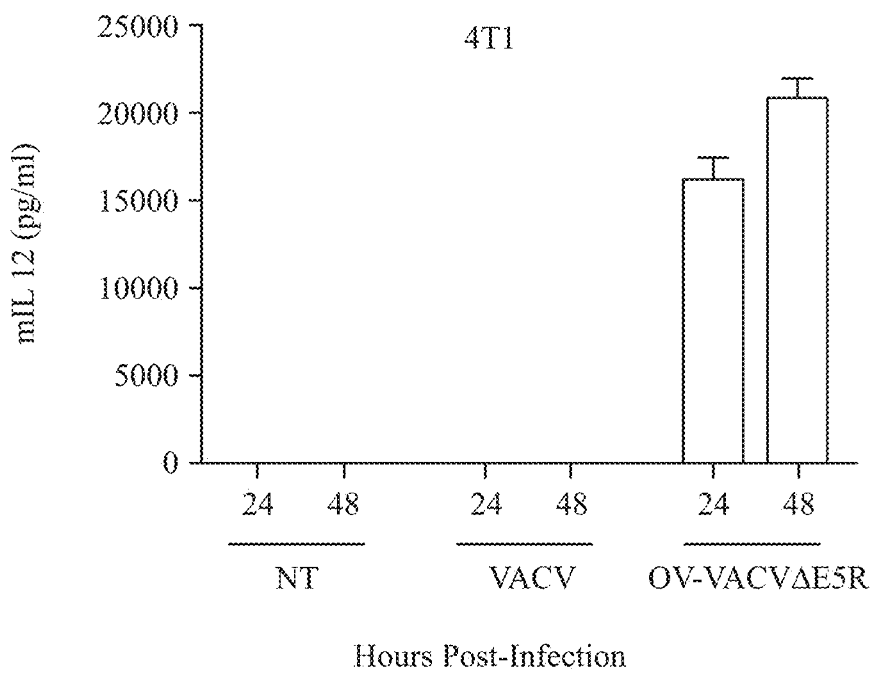
Figure 166C:
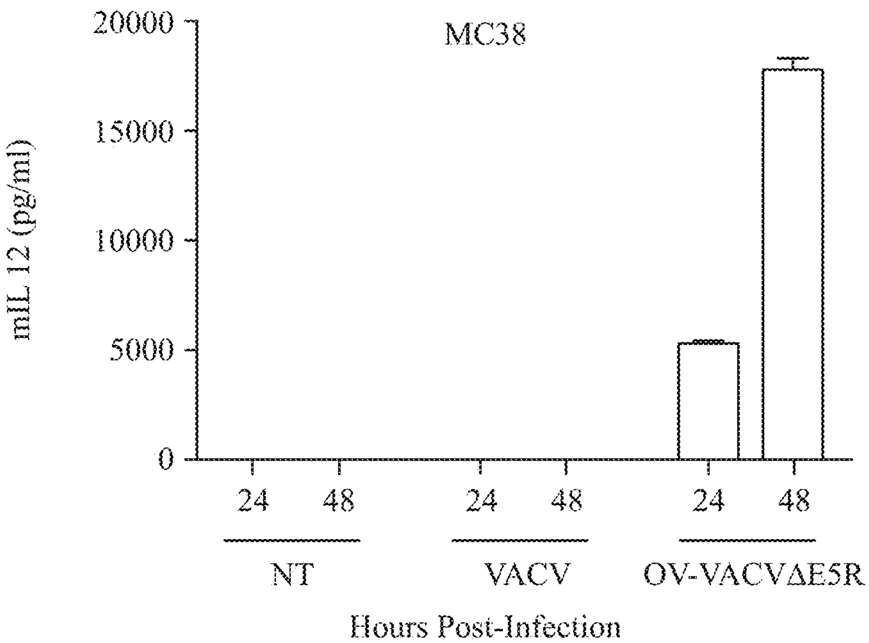
Figure 166D:
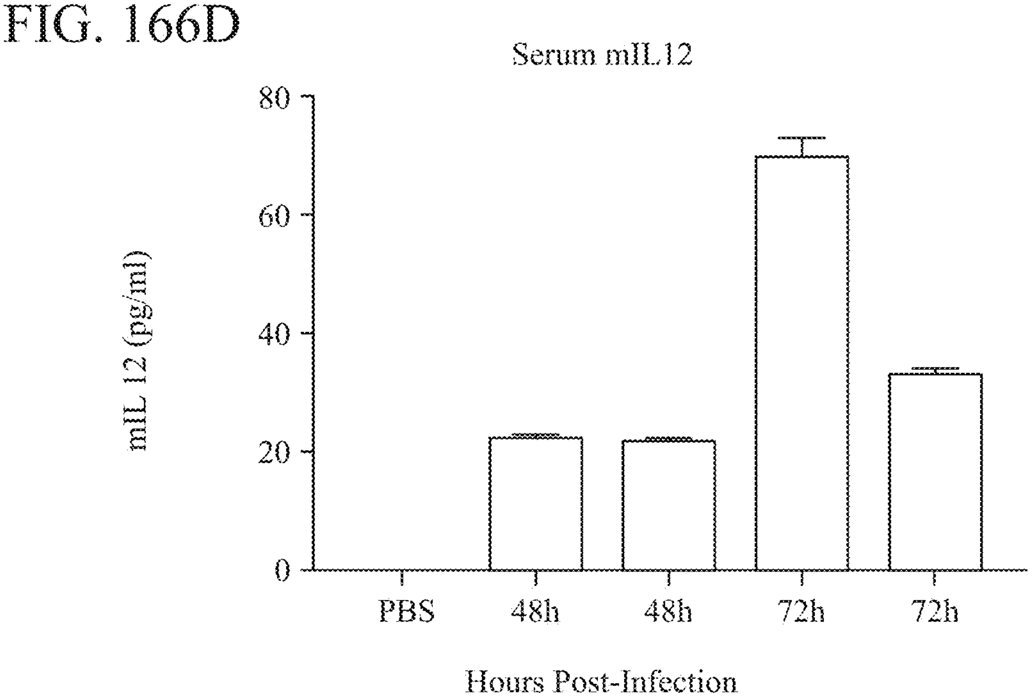

FIGS. 166A-166D. FIGS. 166A-166C show the expression and secretion of murine IL-12 after VACVΔE3L83N-ΔTK-anti-muCTLA-4-ΔE5R-hFl3L-mOX40L-mIL-12 (OV-VACVΔE5R) virus infection of three different murine cancer cell lines. Tumor cells were infected with VACV, VACVΔE3L83N-ΔTK-anti-muCTLA-4-ΔE5R-hFl3L-mOX40L-mIL-12, or mock infected. Supernatant were collected at 24 and 48 hours after virus infection and the concentration of IL-12 in cell culture supernatant were determined by ELISA. FIG. 166A shows the mIL-12 levels in OV-VACVΔE5R-infected B16-F10 melanoma cells. FIG. 166B shows the mIL-12 levels in OV-VACVΔE5R-infected 4T1 breast cancer cells. FIG. 166C shows the mIL-12 level in OV-VACVΔE5R-infected MC38 colon cancer cells. FIG. 166D shows serum mIL-12 levels in mice treated with OV-VACVΔE5R. At 48 h and 72 h post intratumoral injection of the virus, mice were euthanized and blood/serum was collected for cytokine measurement by ELISA.

Figure 167A:
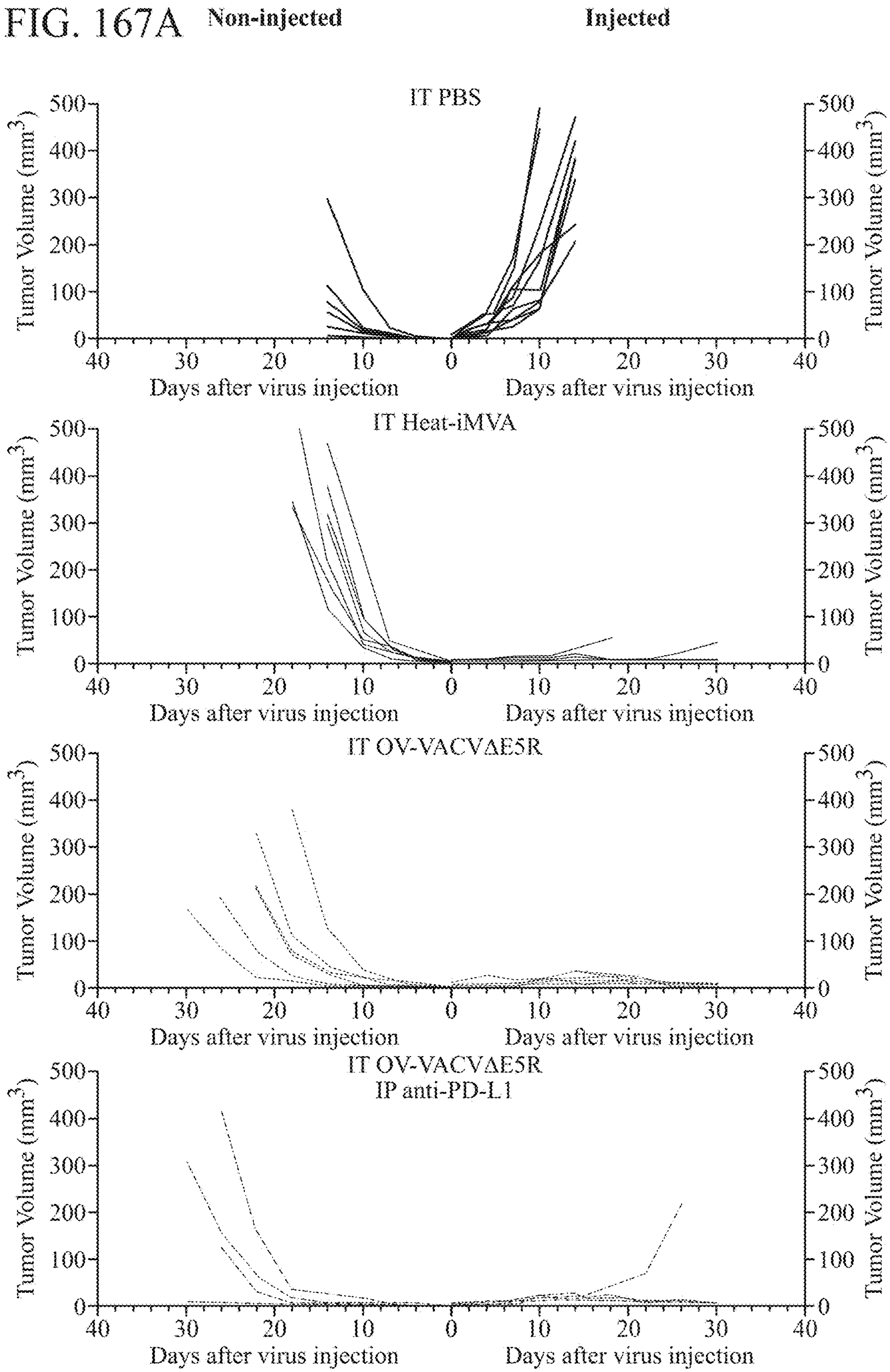
Figure 167B:
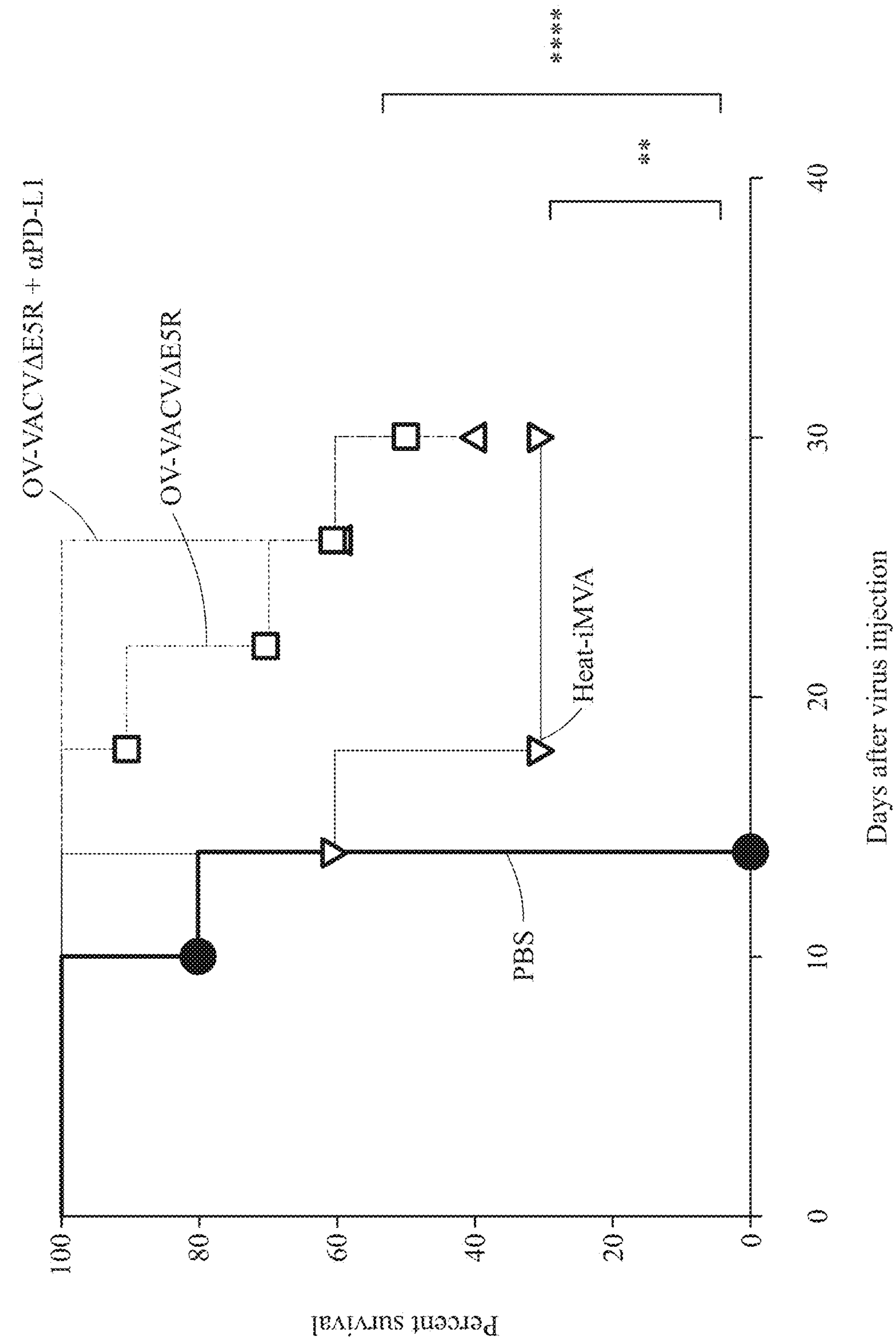

FIGS. 167A-167B shows antitumor efficacy of intratumoral delivery of VACVΔE3L83N-ΔTK-anti-muCTLA-4-ΔE5R-hFl3L-mOX40L-mIL-12 (OV-VACVΔE5R) either alone or in combination with anti-PD-L1 antibody in a bilateral B16-F10 tumor implantation model. Briefly, B16-F10 melanoma cells were implanted intradermally to the left and right flanks of C57B/6J mice ($5\times10^5$ to the right flank and $1\times10^5$ to the left flank). Seven days post tumor implantation, $4\times10^7$ pfu of either VACVΔE3L83N-ΔTK-anti-muCTLA-4-ΔE5R-hFl3L-mOX40L-mIL-12 (OV-VACVΔE5R), Heat-iMVA, or PBS was intratumorally (IT) injected into the larger tumors on the right flank twice per week. One group of the mice also received anti-PD-L1 antibody (250 μg) twice a week in conjunction with IT VACVΔE3L83N-ΔTK-anti-muCTLA-4-ΔE5R-hFlt3L-mOX40L-mIL-12 (OV-VACVΔE5R). Tumor volumes and mice survival were monitored. FIG. 167A shows tumor volumes of both injected and non-injected tumors in mice treated with either PBS or VACVΔE3L83N-ΔTK-anti-muCTLA-4-ΔE5R-hFlt3L-mOX40L-mIL-12 (OV-VACVΔE5R), Heat-iMVA intratumorally, or with the combination of IT VACVΔE3L83N-ΔTK-anti-muCTLA-4-ΔE5R-hFlt3L-mOX40L-mIL-12 (OV-VACVΔE5R) plus IP anti-PD-L1. FIG. 167B shows the Kaplan Meier survival curve of the four groups.

Figure 168A:
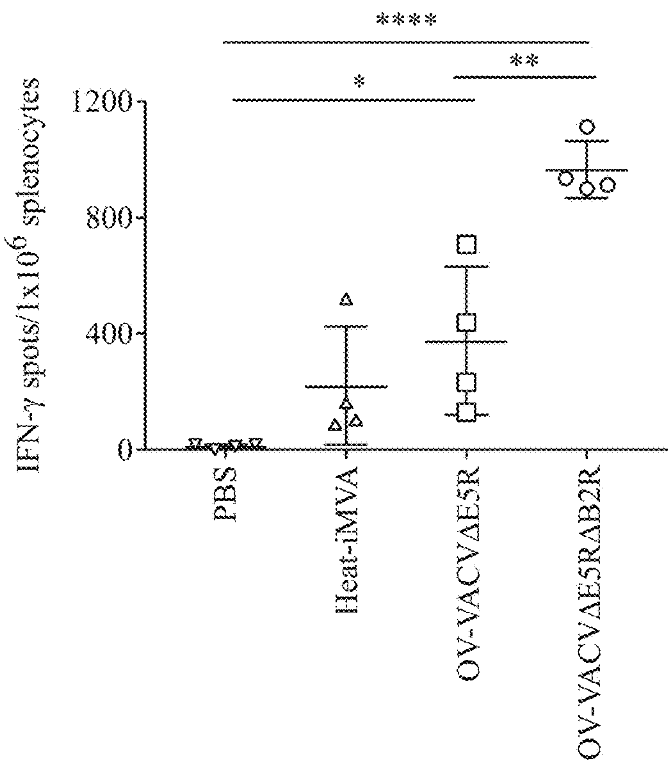
Figure 168B:
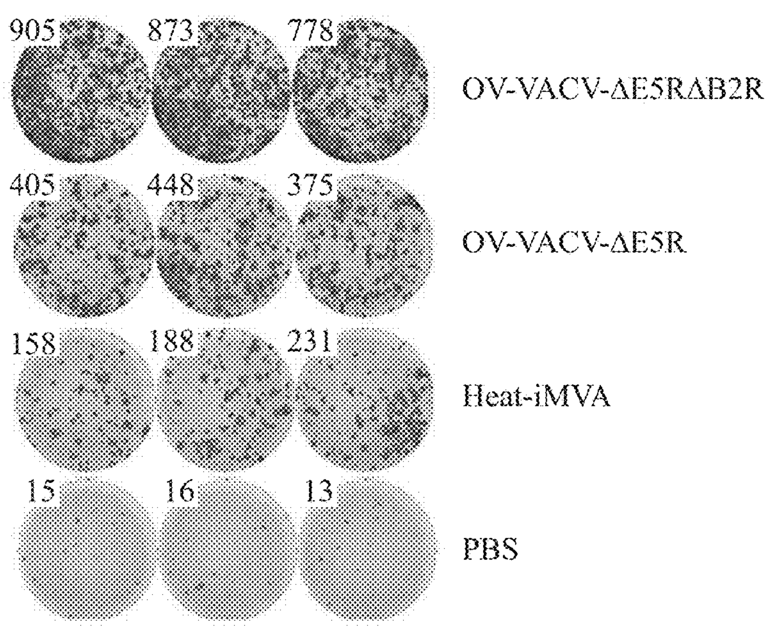

FIGS. 168A-168B show that intratumoral injection of VACVΔE3L83N-ΔTK-anti-muCTLA-4-ΔE5R-hFl3L-mOX40L-mIL-12ΔB2R (OV-VACVΔE5RΔB2R) generated stronger antitumor-specific T cells in the spleens compared with VACVΔE3L83N-ΔTK-anti-muCTLA-4-ΔE5R-hFl3L-mOX40L-mIL-12 (OV-VACVΔE5R) or Heat-iMVA. Briefly, B16-F10 melanoma cells were implanted intradermally to the left and right flanks of C57B/6J mice ($5\times10^5$ to the right flank and $2.5\times10^5$ to the left flank). Seven days post tumor implantation, $4\times10^7$ pfu of either OV-VACVΔE5RΔB2R, OV-VACVΔE5R, an equivalent amount of Heat-iMVA, or PBS was intratumorally (IT) injected into the larger tumors on the right flank twice, three days apart. Spleens were harvested at 2 days post second injection, ELISPOT analyses were performed to evaluate tumor-specific T cells in the spleens. ELISPOT assay was performed by co-culturing irradiated B16-F10 cells (150,000) and splenocytes (1,000,000) in a 96-well plate. FIG. 168A: Graph of IFN-$\gamma^+$ spots per 1,000,000 splenocytes. Each dot represents splenocytes from an individual mouse (n=4) (*P<0.05; P<0.01, P<0.0001, t test). FIG. 168**B: Image of ELISPOT of triplicate samples of combined splenocytes from mice in the same treatment group.

Figure 169:
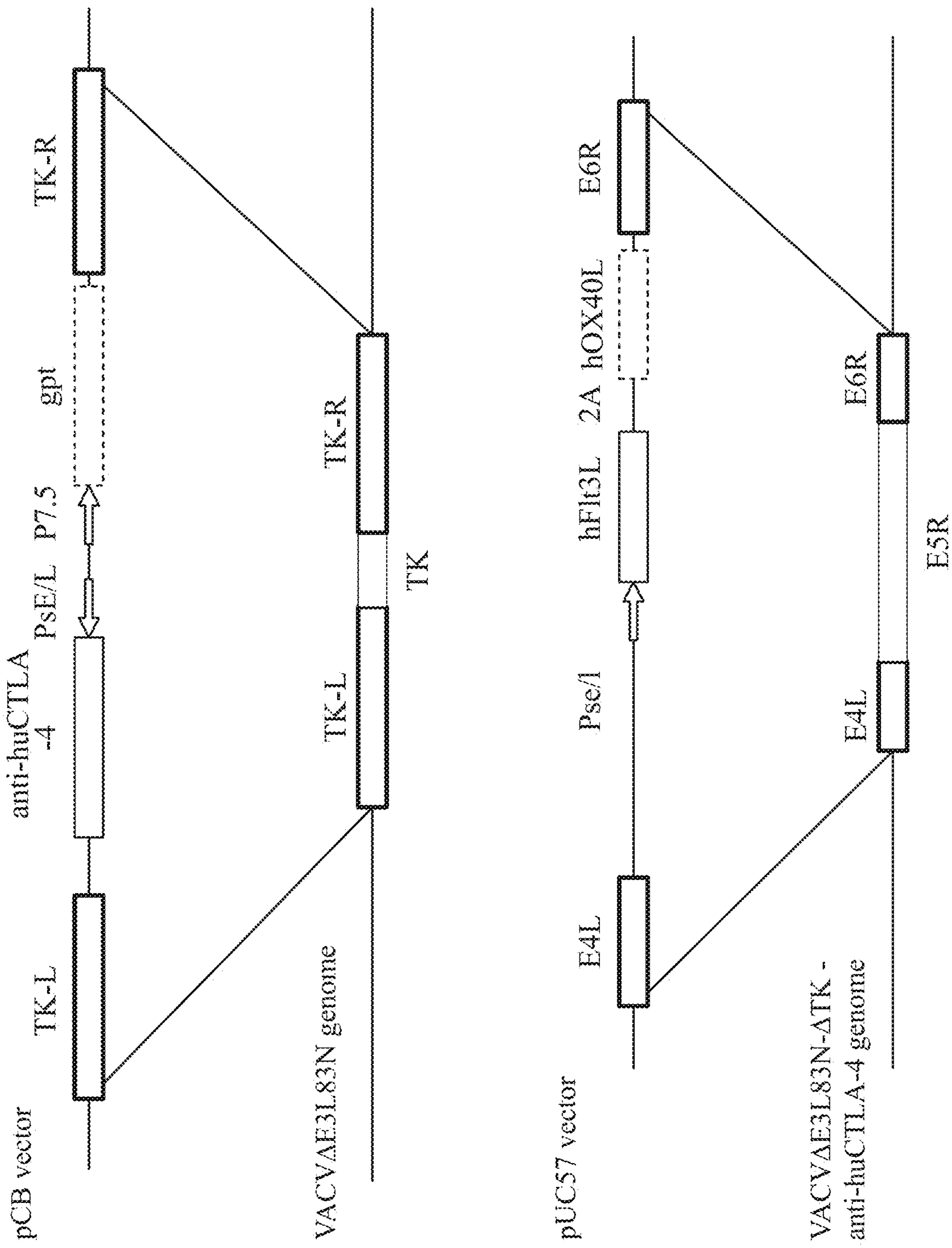

FIG. 169 shows a scheme of stepwise strategy to generate recombinant VACVΔE3L83NΔTKΔE5R virus expressing anti-huCTLA-4 antibody, and hFl3L, hOX40L and hIL12 proteins through homologous recombination first at the TK and then at the E5R loci of the VACVΔE3L83N genome. pCB vector was used to insert a single expression cassette to express the anti-huCTLA-4 antibody heavy and light chains under the control of the vaccinia virus synthetic early and late promoter (PsE/L). Homologous recombination that occurred at the TK-L and TK-R sites results in the insertion of expression cassette of anti-huCTLA-4 antibody into TK locus on VACVΔE3L83N genome, which was generated by deleting the DNA fragment of E3L gene encoding N-terminal 83 amino acid. pUC57 vector was used to insert two expression cassettes designed to express both hFlt3L-hOX40LhOX40L fusion protein and mIL-12 using the vaccinia viral synthetic early and late promoter (PsE/L). The coding sequence of the hFl3L-mOX40L was separated by a furin cleavage site followed by a Pep2A sequence. The coding sequence of p40 and p30 subunits of hIL12 was separated by a furin cleavage site followed by a Pep2A sequence. The C-terminus of p30 subunit was tagged with a matrix binding sequence. Homologous recombination at the E4L and E6R loci results in the insertion of expression cassette for hFlt3L-hOX40LhOX40L and hIL12 into the E5L locus of VACVΔE3L83N-ΔTK-anti-muCTLA-4 genome.

Figure 170:
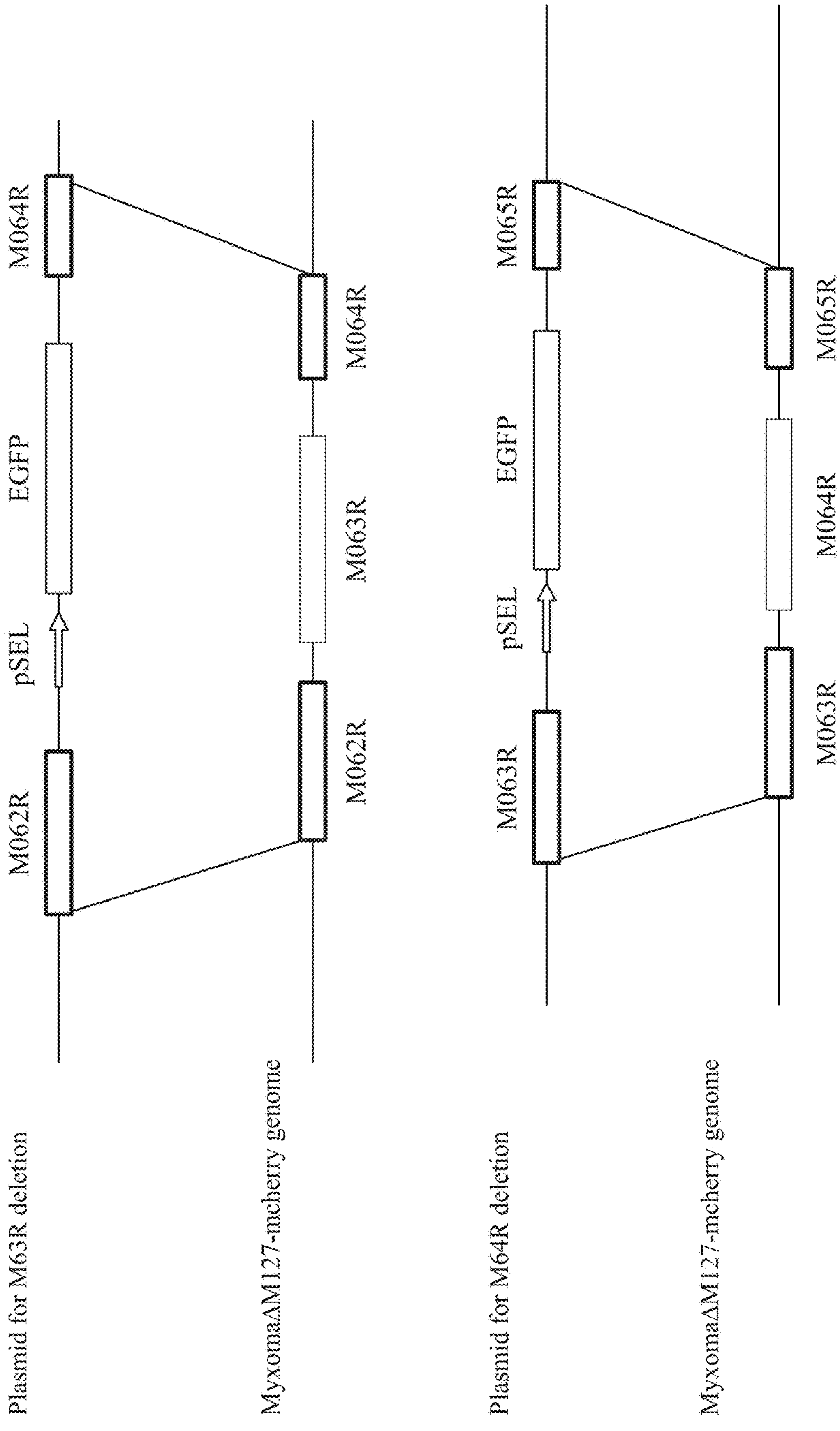

FIG. 170 shows a scheme of generating recombinant myxoma virus (Lausanne strain) with deletion of M063R gene through homologous recombination at the M062R and M064R loci of the myxomaΔM127-mcherry genome, as well as generating recombinant myxoma virus (Lausanne strain) with deletion of M064R gene through homologous recombination at the M063R and M065R loci of the myxomaΔM127-mcherry genome. Homologous recombination that occurred at the M062R and M064R loci results in the deletion of M063R gene from the virus genome to generate MyxomaΔM063R virus. Homologous recombination that occurred at the M063R and M065R loci results in the deletion of M064R gene from the virus genome to generate MyxomaΔM064R virus.

Figure 171A:
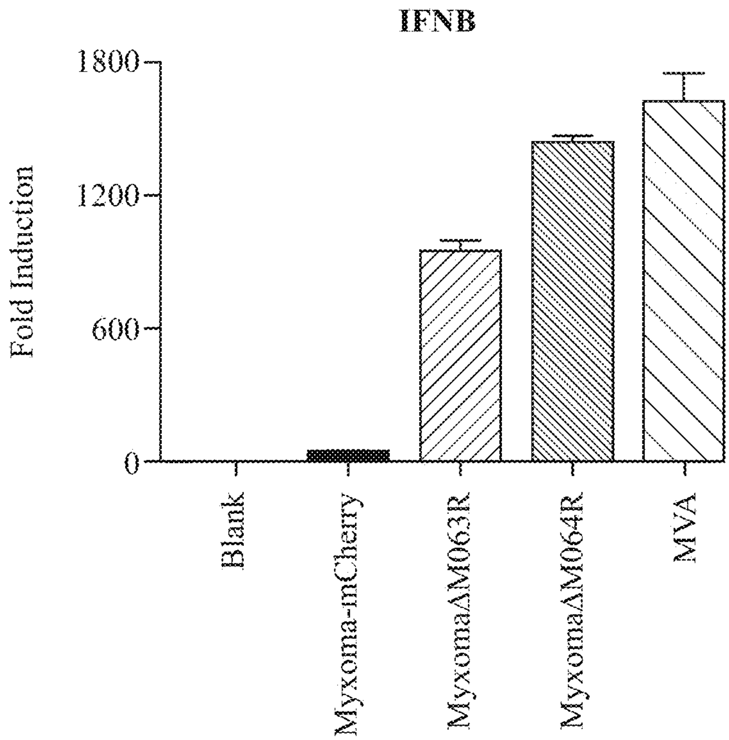
Figure 171B:
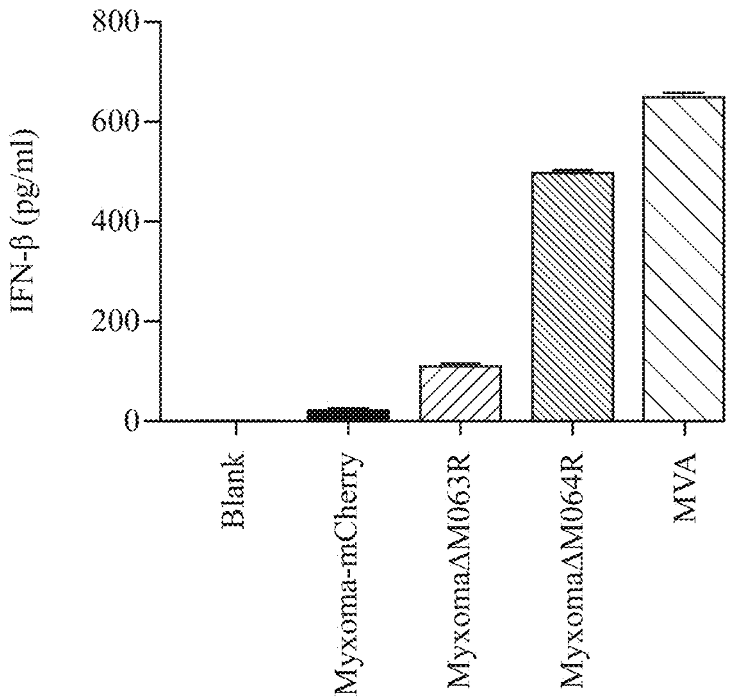

FIGS. 171A-171B show that MyxomaΔM064R and MyxomaΔM063R infection of murine BMDC induce higher levels of IFNB gene expression and IFN-B protein secretion compared with the parental myxoma virus expressing mcherry (Myxoma-mcherry) which also contains a deletion of the M0127 gene. BMDC cells were infected with Myxoma-mcherry, MyxomaΔM063R, MyxomaΔM064R, or MVA at a MOI of 10. Cells were collected at 6 hours post infection and RNAs were extracted. Quantitative RT-PCR analyses were performed to examine the expression of IFNB gene. FIG. 171A shows the RT-PCR result of IFNB gene expression in infected BMDCs. Supernatants were collected at 24 h post infection and IFN-B protein levels in the supernatants were determined by ELISA. FIG. 171B shows the ELISA results of IFN-B protein levels in the supernatants of infected BMDCs.

Figure 172:
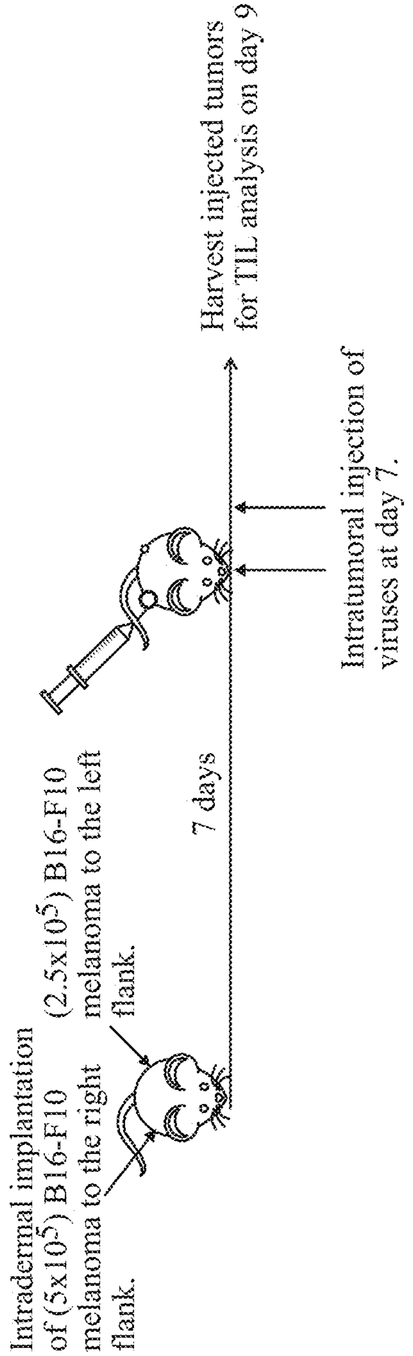

FIGS. 172-174B are a series of graphical representations of data showing that intratumoral injection of myxomaΔM064R or myxoma-mcherry leads to activation of effector $CD4^+$ and $CD8^+$ T cells in a B16-F10 melanoma model. FIG. 172 shows the experimental scheme. Briefly, B16-F10 melanoma cells were implanted intradermally to the left and right flanks of C57B/6J mice ($5\times10^5$ to the right flank and $2.5\times10^5$ to the left flank). Seven days post tumor implantation, $2\times10^7$ pfu of either Myxoma-mCherry, MyxomaΔM064R, MVAΔE5R or PBS was intratumorally (IT) injected into the larger tumors on the right flank. Two days post injection, the injected tumors were isolated and tumor infiltrating lymphocytes were analyzed by FACS. FIG. 172 shows that intratumoral injection of myxomaAOM64R or myxoma-mcherry leads to activation of effector $CD4^+$ and $CD8^+$ T cells in a B16-F10 melanoma model.

Figure 173A:
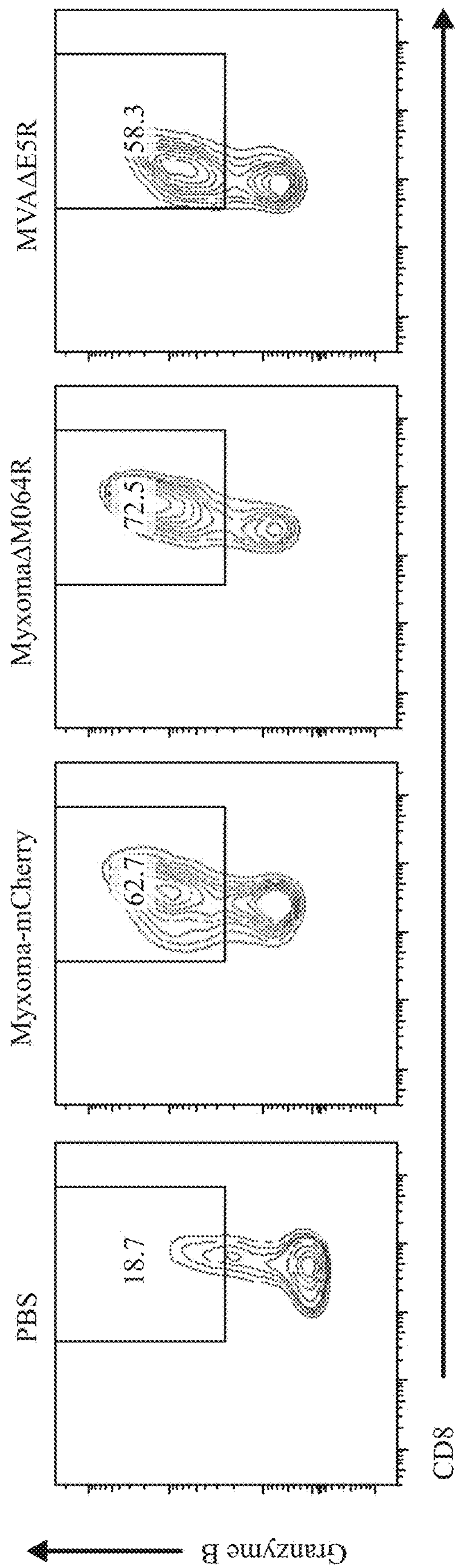
Figure 173B:
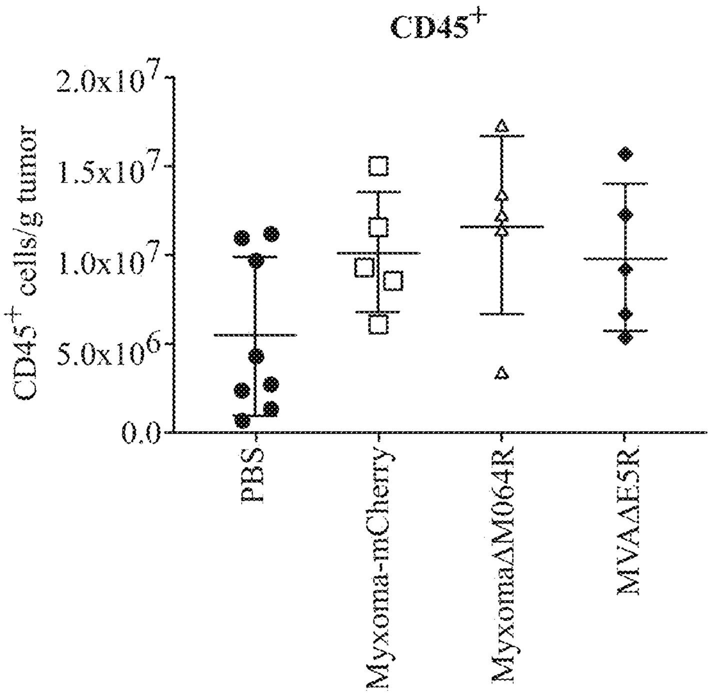
Figure 173C:
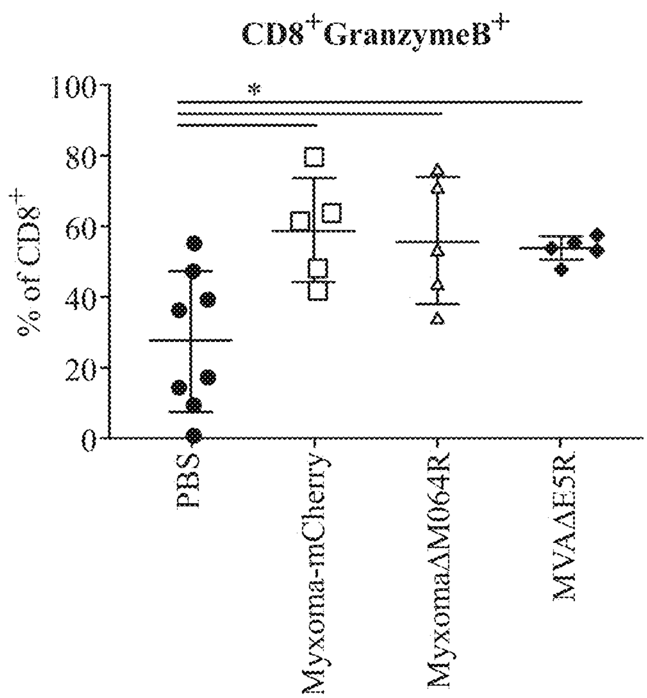

FIG. 173A shows the representative dot plots of Granzyme $B^+$ $CD8^+$ T cells in the injected tumors with either Myxoma-mCherry, MyxomaΔM064R, MVAΔE5R or PBS treatment. FIG. 173B shows the graph of absolute number of $CD45^+$ cells in the injected tumors. Data are means ±SEM (n=5-8). FIG. 173C shows the graph of percentage of Granzyme $B^+$ $CD8^+$ T cells out of $CD8^+$ T cells. Data are means ±SEM (n=5-8) (*P<0.05, t test).

Figure 174A:
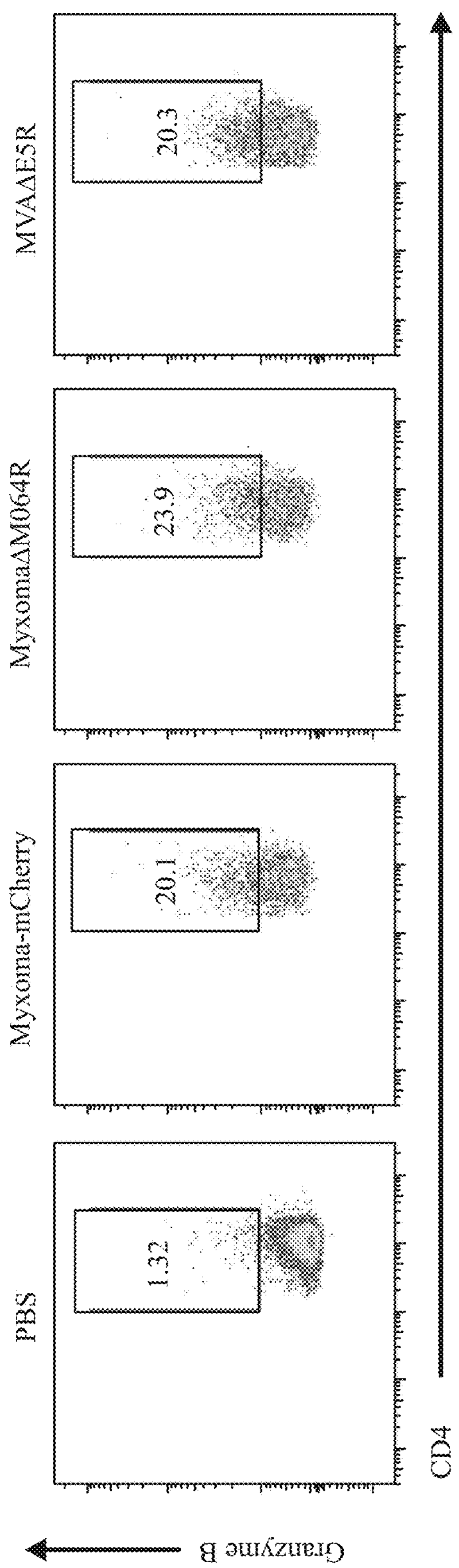
Figure 174B:
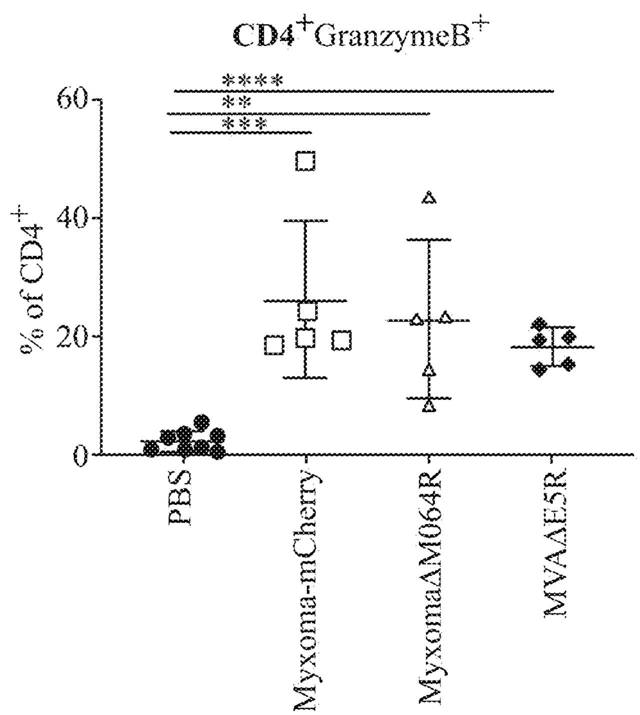

FIG. 174A shows the representative dot plots of Granzyme $B^+$ $CD4^+$ T cells in the injected tumors with either Myxoma-mCherry, MyxomaΔM064R, MVAΔE5R or PBS treatment. FIG. 174B shows the graph of percentage of Granzyme $B^+$ $CD4^+$ T cells out of $CD4^+$ T cells. Data are means ±SEM (n=5-8) (P<0.01; *P<0.001; ****P<0.0001, t test).

DETAILED DESCRIPTION

It is to be appreciated that certain aspects, modes, embodiments, variations, and features of the present technology are described below in various levels of detail in order to provide a substantial understanding of the present technology.

I. Definitions

The definitions of certain terms as used in this specification are provided below. Unless defined otherwise, all technical and scientific terms used herein generally have the same meaning as commonly understood by one of ordinary skill in the art to which this present technology belongs.

As used in this specification and the appended claims, the singular forms "a," "an," and "the" include plural referents unless the content clearly dictates otherwise. For example, reference to "a cell" includes a combination of two or more cells, and the like.

As used herein, the term "about" encompasses the range of experimental error that may occur in a measurement and will be clear to the skilled artisan.

As used herein, the term "adjuvant" refers to a substance that enhances, augments, or potentiates the host's immune response to antigens, including tumor antigens.

As used herein, the "administration" of an agent or drug to a subject includes any route of introducing or delivering to a subject a compound to perform its intended function. Administration can be carried out by any suitable route, including but not limited to, orally, intranasally, parenterally (intravenously, intramuscularly, intradermally, intraperitoneally, or subcutaneously), rectally, intrathecally, intratumorally, or topically. Administration includes self-administration and the administration by another.

As used herein, the term "antigen" refers to a molecule to which an antibody (or antigen binding fragment thereof) can selectively bind. The target antigen may be a protein, carbohydrate, nucleic acid, lipid, hapten, or other naturally occurring or synthetic compound. In some embodiments, the antigen is contained within a whole cell, such as in a tumor antigen-containing whole cell vaccine. In some embodiments, the target antigen encompasses cancer-related antigens or neoantigens and includes proteins or other molecules expressed by tumor or non-tumor cancers, such as molecules that are present in cancer cells but absent in non-cancer cells, and molecules that are up-regulated in cancer cells as compared to non-cancer cells.

As used herein, "attenuated," as used in conjunction with a virus, refers to a virus having reduced virulence or pathogenicity as compared to a non-attenuated counterpart, yet is still viable or live. Typically, attenuation renders an infectious agent, such as a virus, less harmful or virulent to an infected subject compared to a non-attenuated virus. This is in contrast to a killed or completely inactivated virus.

As used herein, "conjoint administration" refers to administration of a second therapeutic modality in combination with one or more engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-AWR199). For example, an immune checkpoint blocking agent, immunomodulatory agent, and/or anti-cancer drug administered in close temporal proximity with one or more engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199). For example, a PD-1/PD-L1 inhibitor and/or a CTLA-4 inhibitor (in more specific embodiments, an antibody) can be administered simultaneously (i.e., concurrently) with one or more engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔΔ83N-ΔTK-anti-CTLA-4-ΔE5R-hFlt3L-OX40L- IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199) (by intravenous or intratumoral injection when the MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199 is administered intratumorally or systemically as stated above) or before or after the MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199 administration. In some embodiments, if the MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199 administration and the immune checkpoint blocking agent, immunomodulatory agent, and/or anti-cancer drug are administered about 1 to about 7 days apart or even up to three weeks apart, this would still be within "close temporal proximity" as stated herein, therefore such administration will qualify as "conjoint."

The term "corresponding wild-type strain" or "corresponding wild-type virus" is used herein to refer to the wild-type MVA, vaccinia virus (VACV), or myxoma virus (MYXV) strain from which the engineered MVA, vaccinia, or myxoma strain or virus was derived. As used herein, a wild-type MVA, vaccinia, or myxoma strain or virus is a strain or virus that has not been engineered to disrupt or delete (knock out) a particular gene of interest and/or to express a heterologous nucleic acid. For example, in some embodiments, a wild-type MVA, vaccinia, or myxoma strain or virus is a strain or virus that has not been engineered to disrupt or delete (knock out) the C7 gene and express OX40L. In other embodiments, a wild-type MVA, vaccinia, or myxoma strain or virus is a strain or virus that has not been engineered to disrupt or delete (knock out) the E5R (or M31R) gene. The engineered MVA, vaccinia, or myxoma strain or virus may have been modified to disrupt or delete (knock out) the C7 gene and express OX40L alone or in combination with further modifications (e.g., engineered to express additional immunomodulatory proteins and/or comprise additional gene deletions) as described herein. Additionally or alternatively, the engineered MVA, vaccinia, or myxoma strain or virus may have been modified to disrupt or delete (knock out) the E5R (or M31R) gene alone or in combination with further modifications (e.g., engineered to express additional immunomodulatory proteins and/or comprise additional gene deletions) as described herein. The term "corresponding MVAΔE3L strain" or "corresponding MVAΔE3L virus" is used herein to refer to the MVA strain or virus having an E3L deletion alone (i.e., an MVAΔE3L strain or virus comprising no other genetic deletions or additions). The term "corresponding MVAΔC7L strain" or "corresponding MVAΔC7L virus" is used herein to refer to the MVA strain or virus having a C7L deletion alone (i.e., an MVAΔC7L strain or virus comprising no other genetic deletions or additions). The term "corresponding MVAΔE5R strain" or "corresponding MVAΔE5R virus" is used herein to refer to the MVA strain or virus having an E5R deletion alone (i.e., an MVAΔE5R strain or virus comprising no other genetic deletions or additions). The term "corresponding VACVΔC7L strain" or "corresponding VACVΔC7L virus" is used herein to refer to the vaccinia strain or virus having a C7L deletion alone (i.e., a VACVΔC7L strain or virus comprising no other genetic deletions or additions). The term "corresponding VACVΔE5R strain" or "corresponding VACVΔE5R virus" is used herein to refer to the vaccinia strain or virus having an E5R deletion alone (i.e., a VACVΔE5R strain or virus comprising no other genetic deletions or additions).

As used herein, the terms "delivering" and "contacting" refer to depositing the one or more engineered poxviruses (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199) of the present disclosure in the tumor microenvironment whether this is done by local administration to the tumor (intratumoral) or by, for example, intravenous route. The term focuses on engineered virus (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199) that reaches the tumor itself. In some embodiments, "delivering" is synonymous with administering, but it is used with a particular administration locale in mind, e.g., intratumoral.

The terms "disruption" and "mutation" are used interchangeably herein to refer to a detectable and heritable change in the genetic material. Mutations may include insertions, deletions, substitutions (e.g., transitions, transversion), transpositions, inversions, knockouts, and combinations thereof. Mutations may involve only a single nucleotide (e.g., a point mutation or a single nucleotide polymorphism) or multiple nucleotides. In some embodiments, mutations are silent, that is, no phenotypic effect of the mutation is detected. In other embodiments, the mutation causes a phenotypic change, for example, the expression level of the encoded product is altered, or the encoded product itself is altered. In some embodiments, a disruption or mutation may result in a disrupted gene with decreased levels of expression of a gene product (e.g., protein or RNA) as compared to the wild-type strain. In other embodiments, a disruption or mutation may result in an expressed protein with activity that is lower as compared to the activity of the expressed protein from the wild-type strain.

As used herein, an "effective amount" or "therapeutically effective amount" refers to a sufficient amount of an agent, which, when administered at one or more dosages and for a period of time, is sufficient to provide a desired biological result in alleviating, curing, or palliating a disease. In the present disclosure, an effective amount of one or more engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199) comprises an amount that (when administered for a suitable period of time and at a suitable frequency) reduces the number of cancer cells; or reduces the tumor size or eradicates the tumor; or inhibits (i.e., slows down or stops) cancer cell infiltration into peripheral organs; inhibits (i.e., slows down or stops) metastatic growth; inhibits (stabilizes or arrests) tumor growth; allows for treatment of the tumor; and/or induces and promotes an immune response against the tumor. An appropriate therapeutic amount in any individual case may be determined by one of ordinary skill in the art using routine experimentation in light of the present disclosure. Such determination may begin with amounts found effective in vitro and amounts found effective in animals. The therapeutically effective amount will be initially determined based on the concentration or concentrations found to confer a benefit to cells in culture. Effective amounts can be extrapolated from data within the cell culture and can be adjusted up or down based on factors such as detailed herein. Effective amounts of the viral constructs are generally within the range of about $10^5$ to about $10^{10}$ plaque forming units (pfu), although a lower or higher dose may be administered. In some embodiments, the dosage is about $10^6$-$10^9$ pfu. In some embodiments, a unit dosage is administered in a volume within the range from 1 to 10 mL. The equivalence of pfu to virus particles can differ according to the specific pfu titration method used. Generally, pfu is equal to about 5 to 100 virus particles. A therapeutically effective amount the hFlt3L transgene bearing viruses can be administered in one or more divided doses for a prescribed period of time and at a prescribed frequency of administration. For example, a therapeutically effective amount of hFlt3L bearing viruses in accordance with the present disclosure may vary according to factors such as the disease state, age, sex, weight, and general condition of the subject, and the potency of the viral constructs to elicit a desired immunological response in the particular subject for the particular cancer.

With particular reference to the viral-based immunostimulatory agents disclosed herein, an "effective amount" or "therapeutically effective amount" refers to an amount of a composition comprising one or more one or more engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYMVAΔWR199, and/or MVAΔE5R-hFlt3L-OX40L-ΔWR199) sufficient to reduce, inhibit, or abrogate tumor cell growth, thereby reducing or eradicating the tumor, or sufficient to inhibit, reduce or abrogate metastatic spread either in vitro, ex vivo, or in a subject or to elicit and promote an immune response against the tumor that will eventually result in one or more of metastatic spread reduction, inhibition, and/or abrogation as the case may be. The reduction, inhibition, or eradication of tumor cell growth may be the result of necrosis, apoptosis, or an immune response, or a combination of two or more of the foregoing (however, the precipitation of apoptosis, for example, may not be due to the same factors as observed with oncolytic viruses). The amount that is therapeutically effective may vary depending on such factors as the particular virus used in the composition, the age and condition of the subject being treated, the extent of tumor formation, the presence or absence of other therapeutic modalities, and the like. Similarly, the dosage of the composition to be administered and the frequency of its administration will depend on a variety of factors, such as the potency of the active ingredient, the duration of its activity once administered, the route of administration, the size, age, sex, and physical condition of the subject, the risk of adverse reactions and the judgment of the medical practitioner. The compositions are administered in a variety of dosage forms, such as injectable solutions.

With particular reference to combination therapy with an immune checkpoint inhibitor, an "effective amount" or "therapeutically effective amount" for an immune checkpoint blocking agent means an amount of an immune checkpoint blocking agent sufficient to reverse or reduce immune suppression in the tumor microenvironment and to activate or enhance host immunity in the subject being treated. Immune checkpoint blocking agents include, but are not limited to, inhibitory antibodies against CD28 inhibitor such as CTLA-4 (cytotoxic T lymphocyte antigen 4) (e.g., ipilimumab), anti-PD-1 (programmed Death 1) inhibitory antibodies (e.g., nivolumab, pembrolizumab, pidilizumab, lambrolizumab), and anti-PD-L1 (Programmed death ligand 1) inhibitory antibodies (MPDL3280A, BMS-936559, MEDI4736, MSB 00107180), as well as inhibitory antibodies against LAG-3 (lymphocyte activation gene 3), TIM3 (T-cell immunoglobulin and mucin-3), B7-H3, TIGIT (T-cell immunoreceptor with Ig and ITIM domains), AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, or PDR001, and combinations thereof. Dosage ranges of the foregoing are known or readily within the skill in the art as several dosing clinical trials have been completed, making extrapolation to other agents possible.

In some embodiments, the tumor expresses the particular checkpoint, but in the context of the present technology, this is not strictly necessary as immune checkpoint blocking agents block more generally immune suppressive mechanisms within the tumors, elicited by tumor cells, stromal cells, and tumor-infiltrating immune cells.

For example, the CTLA-4 inhibitor ipilimumab, when administered as adjuvant therapy after surgery in melanoma, is administered at 1-2 mg/mL over 90 minutes for a total infusion amount of 3 mg/kg every three weeks for a total of 4 doses. This therapy is often accompanied by severe, even life-threatening, immune-mediated adverse reactions, which limits the tolerated dose as well as the cumulative amount that can be administered. It is anticipated that it will be possible to reduce the dose and/or cumulative amount of ipilimumab when it is administered conjointly with one or more engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199). In particular, in light of the experimental results set forth below, it is anticipated that it will be further possible to reduce the CTLA-4 inhibitor's dose if it is administered directly to the tumor conjointly with one or both the foregoing MVA viruses. Accordingly, the amounts provided above for ipilimumab may be a starting point for determining the particular dosage and cumulative amount to be given to a patient in conjoint administration.

As another example, pembrolizumab is prescribed for administration as adjuvant therapy in melanoma diluted to 25 mg/mL. It is administered at a dosage of 2 mg/kg over 30 minutes every three weeks. This may be a starting point for determining dosage and administration in the conjoint administration of one or more engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199).

Nivolumab could also serve as a starting point in determining the dosage and administration regimen of checkpoint inhibitors administered in combination with one or more engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199). Nivolumab is prescribed for administration at 3 mg/kg as an intravenous infusion over 60 minutes every two weeks.

Immune stimulating agents such as agonist antibodies have also been explored as immunotherapy for cancers. For example, anti-ICOS antibody binds to the extracellular domain of ICOS leading to the activation of ICOS signaling and T-cell activation. Anti-OX40 antibody can bind to OX40 and potentiate T-cell receptor signaling leading to T-cell activation, proliferation and survival. Other examples include agonist antibodies against 4-1BB (CD137), GITR.

The immune stimulating agonist antibodies can be used systemically in combination with intratumoral injection of one or more engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199). Alternatively, the immune stimulating agonist antibodies can be used conjointly with one or more engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199) via intratumoral delivery either simultaneously (i.e., concurrently) or sequentially.

The term "immunomodulatory drug" is used herein to refer to Fingolimod (FTY720).

The terms "engineered" or "genetically engineered" are used herein to refer to an organism that has been manipulated to be genetically altered, modified, or changed, e.g., by disruption of the genome. For example, an "engineered vaccinia virus strain," "engineered modified vaccinia Ankara virus," or "engineered myxoma virus" refers to a vaccinia, modified vaccinia Ankara, or myxoma strain that has been manipulated to be genetically altered, modified, or changed. In the present context, "engineered" or "genetically engineered" includes recombinant vaccinia viruses, recombinant modified vaccinia Ankara viruses, and recombinant myxoma viruses.

The term "gene cassette" is used herein to refer to a DNA sequence encoding and capable of expressing one or more genes of interest (e.g., OX40L, hFlt3L, a selectable marker, or a combination thereof) that can be inserted between one or more selected restriction sites of a DNA sequence. In some embodiments, insertion of a gene cassette results in a disrupted gene. In some embodiments, disruption of the gene involves replacement of at least a portion of the gene with a gene cassette, which includes a nucleotide sequence encoding a gene of interest (e.g., OX40L, hFlt3L, a selectable marker, or a combination thereof).

As used herein, "heterologous nucleic acid," refers to a nucleic acid, DNA, or RNA, which has been introduced into a virus, and which is not a copy of a sequence naturally found in the virus into which it is introduced. Such heterologous nucleic acid may comprise segments that are a copy of a sequence that is naturally found in the virus into which it has been introduced.

As used herein, wherever a gene is described, the gene may be either human or murine such that the designation of human (h or hu) or murine (m or mu) may be used interchangeably and is not intended to be limiting. For example, where mIL-12 is described, hIL-12 may be substituted for mIL-12 in the described constructs, and vice versa.

As used herein, "IL-15/IL-15Rα" encompasses membrane bound hIL-15/IL-15Rα transpresentation constructs and fusion proteins as described in Van den Bergh et al. (*Pharmacology & Therapeutics* 170:73-79 (2017); Kowalsky et al. (*Molecular Therapy* 26(10):2476-2486 (2018); Stoklasek et al. (*J. Immunol.* 177:6072-6080); Duboi et al. (*J. Immunol.* 180:2099-2106 (2008); Epardaud et al, (*Cancer Res.* 68:2972-2983 (2008); and Dubois et al. (*Immunity* 17:537-547 (2002), each of which is herein incorporated by reference.

As used herein, "immune checkpoint inhibitor" or "immune checkpoint blocking agent" or "immune checkpoint blockade inhibitor" refers to molecules that completely or partially reduce, inhibit, interfere with, or modulate the activity of one or more checkpoint proteins. Checkpoint proteins regulate T-cell activation or function. Checkpoint proteins include, but are not limited to, CD28 receptor family members, CTLA-4 and its ligands CD80 and CD86; PD-1 and its ligands PD-L1 and PD-L2; LAG3, B7-H3, B7-H4, TIM3, ICOS, II DLBCL, BTLA or any combination of two or more of the foregoing. Non-limiting examples of immune checkpoint blocking agents contemplated for use herein include, but are not limited to, inhibitory antibodies against CD28 inhibitor such as CTLA-4 (cytotoxic T lymphocyte antigen 4) (e.g., ipilimumab), anti-PD-1 (programmed Death 1) inhibitory antibodies (e.g., nivolumab, pembrolizumab, pidilizumab, lambrolizumab), and anti-PD-L1 (Programmed death ligand 1) inhibitory antibodies (MPDL3280A, BMS-936559, MEDI4736, MSB 00107180), as well as inhibitory antibodies against LAG-3 (lymphocyte activation gene 3), TIM3 (T-cell immunoglobulin and mucin-3), B7-H3, TIGIT (T-cell immunoreceptor with Ig and ITIM domains), AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, or BTLA, PDR001, and combinations thereof.

As used herein, "immune response" refers to the action of one or more of lymphocytes, antigen presenting cells, phagocytic cells, granulocytes, and soluble macromolecules produced by the above cells or the liver (including antibodies, cytokines, and complement) that results in selective damage to, destruction of, or elimination from the human body of cancerous cells, metastatic tumor cells, etc. An immune response may include a cellular response, such as a T-cell response that is an alteration (modulation, e.g., significant enhancement, stimulation, activation, impairment, or inhibition) of cellular, i.e., T-cell function. A T-cell response may include generation, proliferation or expansion, or stimulation of a particular type of T-cell, or subset of T-cells, for example, effector $CD4^+$, $CD4^+$ helper, effector $CD8^+$, $CD8^+$ cytotoxic, or natural killer (NK) cells. Such T-cell subsets may be identified by detecting one or more cell receptors or cell surface molecules (e.g., CD or cluster of differentiation molecules). A T-cell response may also include altered expression (statistically significant increase or decrease) of a cellular factor, such as a soluble mediator (e.g., a cytokine, lymphokine, cytokine binding protein, or interleukin) that influences the differentiation or proliferation of other cells. For example, Type I interferon (IFN-$\alpha$/$\beta$) is a critical regulator of the innate immunity (Huber et al., *Immunology* 132(4):466-474 (2011)). Animal and human studies have shown a role for IFN-$\alpha$/$\beta$ in directly influencing the fate of both $CD4^+$ and $CD8^+$ T-cells during the initial phases of antigen recognition and anti-tumor immune response. IFN Type I is induced in response to activation of dendritic cells, in turn a sentinel of the innate immune system. An immune response may also include humoral (antibody) response.

The term "immunogenic composition" is used herein to refer to a composition that will elicit an immune response in a mammal that has been exposed to the composition. In some embodiments, an immunogenic composition comprises MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-$TK^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, and/or MVAΔE5R-hFlt3L-OX40L-ΔWR199, an antigen, an adjuvant comprising any one or more of the foregoing engineered viruses, and/or an adjuvant comprising MVAΔC7L-hFlt3L-TK(−)-OX40L, MVAΔE5R-hFlt3L-OX40L, MVAΔC7LΔE5R-hFlt3L-OX40L, and/or Heat-iMVAΔE5R alone or in combination with immune checkpoint blockade inhibitors. As used herein, an immunogenic composition encompasses vaccines. In some embodiments, the immunogenic composition comprises a tumor antigen-containing whole cell vaccine (e.g., an irradiated whole cell vaccine).

As used herein, the term "inactivated MVA" refers to heat-inactivated MVA (Heat-iMVA) and/or UV-inactivated MVA which are infective, nonreplicative, and do not suppress IFN Type I production in infected DC cells. As used herein, the term "inactivated vaccinia virus" includes heat-inactivated vaccinia virus and/or UV-inactivated vaccinia virus. MVA or vaccinia virus inactivated by a combination of heat and UV radiation is also within the scope of the present disclosure.

As used herein, "Heat-inactivated MVA" (Heat-iMVA) and "Heat-inactivated vaccinia virus" refer to MVA and vaccinia virus, respectively, which have been exposed to heat treatment under conditions that do not destroy its immunogenicity or its ability to enter target cells (tumor cells) but remove residual replication ability of the virus as well as factors that inhibit the host's immune response. An example of such conditions is exposure to a temperature within the range of about 50 to about 60° C. for a period of time of about an hour. Other times and temperatures can be determined by one of skill in the art.

As used herein, "UV-inactivated MVA" and "UV-inactivated vaccinia virus" refer to MVA and vaccinia virus, respectively, that have been inactivated by exposure to UV under conditions that do not destroy its immunogenicity or its ability to enter target cells (tumor cells) but remove residual replication ability of the virus. An example of such conditions, which can be useful in the present methods, is exposure to UV using, for example, a 365 nm UV bulb for a period of about 30 min to about 1 hour. Other limits of these conditions of UV wavelength and exposure can be determined by one of skill in the art.

A "knock out," "knocked out gene," or a "gene deletion" refers to a gene including a null mutation (e.g., the wild-type product encoded by the gene is not expressed, expressed at levels so low as to have no effect, or is non-functional). In some embodiments, the knocked out gene includes heterologous sequences (e.g., one or more gene cassettes comprising a heterologous nucleic acid sequence) or genetically engineered non-functional sequences of the gene itself, which renders the gene non-functional. In other embodiments, the knocked out gene is lacking a portion of the wild-type gene. For example, in some embodiments, at least about 10%, at least about 20%, at least about 30%, at least about 40%, or at least about 60% of the wild-type gene sequence is deleted. In other embodiments, the knocked out gene is lacking at least about 70%, at least about 75%, at least about 80%, at least about 90%, at least about 95% or at least about 100% of the wild-type gene sequence. In other embodiments, the knocked out gene may include up to 100% of the wild-type gene sequence (e.g., some portion of the wild-type gene sequence may be deleted) but also include one or more heterologous and/or non-functional nucleic acid sequences inserted therein.

As used herein, "metastasis" refers to the spread of cancer from its primary site to neighboring tissues or distal locations in the body. Cancer cells (including cancer stem cells) can break away from a primary tumor, penetrate lymphatic and blood vessels, circulate through the bloodstream, and grow in normal tissues elsewhere in the body. Metastasis is a sequential process, contingent on tumor cells (or cancer stem cells) breaking off from the primary tumor, traveling through the bloodstream or lymphatics, and stopping at a distant site. Once at another site, cancer cells re-penetrate through the blood vessels or lymphatic walls, continue to multiply, and eventually form a new tumor (metastatic tumor). In some embodiments, this new tumor is referred to as a metastatic (or secondary) tumor.

As used herein, "MVA" means "modified vaccinia Ankara" and refers to a highly attenuated strain of vaccinia derived from the Ankara strain and developed for use as a vaccine and vaccine adjuvant. The original MVA was isolated from the wild-type Ankara strain by successive passage through chicken embryonic cells. Treated thus, it lost about 15% of the genome of wild-type vaccinia including its ability to replicate efficiently in primate (including human) cells. (Mayr et al., *Zentralbl Bakteriol B* 167:375-390 (1978)). MVA is considered an appropriate candidate for development as a recombinant vector for gene or vaccination delivery against infectious diseases or tumors. (Verheust et al., *Vaccine* 30(16):2623-2632 (2012)). MVA has a genome of 178 kb in length and a sequence first disclosed in Antoine et al., *Virol.* 244(2):365-396 (1998). Sequences are also disclosed in GenBank Accession No. U94848.1 (SEQ ID NO: 1). Clinical grade MVA is commercially and publicly available from Bavarian Nordic A/S Kvistgaard, Denmark. Additionally, MVA is available from ATCC, Rockville, MD, and from CMCN (Institut Pasteur Collection Nationale des Microorganismes) Paris, France.

The term "MVAΔC7L," is used herein to refer to a modified vaccinia Ankara (MVA) mutant virus or a vaccine comprising the virus, in which the C7 gene is not expressed, expressed at levels so low as to have no effect, or the expressed protein is non-functional (e.g., is a null-mutation). As used herein, "MVAΔC7L" includes a deletion mutant of MVA which lacks a functional C7L gene and is infective but non-replicative and it is further impaired in its ability to evade the host's immune system. As used herein, "MVAΔC7L" encompasses a recombinant MVA virus that does not express a functional C7 protein. In some embodiments, the ΔC7L mutant includes a heterologous nucleic acid sequence in place of all or a majority of the C7L gene sequence. For example, as used herein, "MVAΔC7L" encompasses a recombinant MVA nucleic acid sequence, wherein the nucleic acid sequence corresponding to the position of C7 in the MVA genome (e.g., position 18,407 to 18,859 of SEQ ID NO: 1) is replaced with a heterologous nucleic acid sequence comprising an open reading frame that encodes a specific gene of interest (SG), such as human OX40L ("MVAΔC7L-OX40L") or human Fms-like tyrosine kinase 3 ligand (hFlt3L) ("MVAΔC7L-hFlt3L"). In some embodiments, the heterologous nucleic acid sequence comprises an open reading frame that encodes a selectable marker. In some embodiments, the selectable marker is a fluorescent protein (e.g., gpt, GFP, mCherry). In some embodiments, the MVAΔC7L virus encompasses a recombinant MVA virus that does not express a functional thymidine kinase (TK) protein. In some embodiments, a specific gene of interest (e.g., OX40L, hFlt3L) is inserted into the TK locus of the MVA genome (e.g., position 75,560 to 76,093 of SEQ ID NO: 1), splitting the TK gene and obliterating it ("MVAΔC7L-OX40L-TK(−)"; "MVAΔC7L-hFlt3L-TK(−)"). In some embodiments, MVAΔC7L encompasses a recombinant MVA virus in which all or a majority of the C7L gene sequence is replaced by a first specific gene of interest (e.g., hFlt3L) and a second gene of interest (e.g., OX40L) is inserted into the TK locus ("MVAΔC7L-hFlt3L-TK(−)-OX40L"). In some embodiments, the recombinant MVAΔC7L-OX40L viruses of the present technology are further modified to express at least one further heterologous gene, such as any one or more of hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L (where "h" or "hu" designates the human protein), and/or include at least one further viral gene mutation or deletion, such as any one or more of the following deletions: E3L (ΔE3L); E3LΔ83N; B2R (ΔB2R), B19R (B18R; ΔWR200); E5R; K7R; C12L (IL18BP); B8R; B14R; N1L; C11R; K1L; M1L; N2L; and/or WR199. For example, in some embodiments, MVAΔC7L-hFlt3L-TK(−)-OX40 is further modified to comprise a deletion of E5R, in which the E5R gene is replaced by a selectable marker (e.g., mCherry) through homologous recombination at the E4L and E6R loci. In some embodiments, MVAΔC7L is modified to express one or more heterologous genes from within other loci, such as the E5R locus. For example, in some embodiments, MVAΔC7L encompasses a recombinant MVA virus in which all or a majority of the E5R gene sequence is replaced by a first specific gene of interest (e.g., hFtl3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as "MVAΔC7LΔE5R-hFlt3L-OX40L." In other embodiments, the recombinant MVAΔC7L-OX40L viruses of the present technology contain no further heterologous genes and/or viral gene mutations other than those specifically referred to in the name of the virus.

The term "MVAΔE3L" means a deletion mutant of MVA which lacks a functional E3L gene and is infective but non-replicative and it is further impaired in its ability to evade the host's immune system. It has been used as a vaccine vector to transfer tumor or viral antigens. The mutant MVA E3L knockout and its preparation have been described in U.S. Pat. No. 7,049,145, for example. As used herein, "MVAΔE3L" encompasses a recombinant MVA modified to express a specific gene of interest (SG), such as OX40L ("MVAΔE3L-OX40L"). In some embodiments, the MVAΔE3L virus encompasses a recombinant MVA virus that does not express a functional thymidine kinase (TK) protein. In some embodiments, a specific gene of interest (e.g., OX40L, hFlt3L) is inserted into the TK locus, splitting the TK gene and obliterating it ("MVAΔE3L-OX40L-TK(−)"; "MVAΔE3L-hFlt3L-TK(−)"). In some embodiments, the recombinant MVAΔE3L-OX40L viruses of the present technology are further modified to express at least one further heterologous gene, such as any one or more hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one viral gene mutation or deletion, such as any one or more of the following deletions: B2R (ΔB2R), B19R (B18R; ΔWR200); E5R; K7R; C12L (IL18BP); B8R; B14R; N1L; C11R; K1L; M1L; N2L; and/or WR199. In other embodiments, the recombinant MVAΔE3L-OX40L viruses of the present technology do not express any further heterologous genes and/or do not include any additional viral gene mutations or deletions other than those specifically indicated in the name of the virus.

The term "MVAΔE5R," is used herein to refer to a modified vaccinia Ankara (MVA) mutant virus or a vaccine comprising the virus, in which the E5R gene is not expressed, expressed at levels so low as to have no effect, or the expressed protein is non-functional (e.g., is a null-mutation). As used herein, "MVAΔE5R" includes a deletion mutant of MVA which lacks a functional E5R gene and is infective but non-replicative and it is further impaired in its ability to evade the host's immune system. As used herein, "MVAΔE5R" encompasses a recombinant MVA virus that does not express a functional E5 protein. In some embodiments, the ΔE5R mutant includes a heterologous nucleic acid sequence in place of all or a majority of the E5R gene sequence. For example, as used herein, "MVAΔE5R" encompasses a recombinant MVA nucleic acid sequence, wherein the nucleic acid sequence corresponding to the position of E5R in the MVA genome (e.g., position 38,432 to 39,385 of SEQ ID NO: 1) is replaced with a heterologous nucleic acid sequence comprising an open reading frame that encodes a specific gene of interest (SG), such as human OX40L ("MVAΔE5R-OX40L") or human Fms-like tyrosine kinase 3 ligand (hFlt3L) ("MVAΔE5R-hFlt3L"). In some embodiments, MVAΔE5R encompasses a recombinant MVA wherein the E5R locus is modified to express one or more heterologous genes. For example, in some embodiments, MVAΔE5R encompasses a recombinant MVA in which all or a majority of the E5R gene sequence is replaced by a first specific gene of interest (e.g., hFtl3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as "MVAΔE5R-hFlt3L-OX40L." In some embodiments, the heterologous nucleic acid sequence comprises an open reading frame that encodes a selectable marker. In some embodiments, the selectable marker is a fluorescent protein (e.g., gpt, GFP, mCherry). In some embodiments, the MVAΔE5R virus encompasses a recombinant MVA virus that does not express a functional thymidine kinase (TK) protein. In some embodiments, a specific gene of interest (e.g., OX40L, hFlt3L) is inserted into the TK locus of the MVA genome (e.g., position 75,560 to 76,093 of SEQ ID NO: 1), splitting the TK gene and obliterating it ("MVAΔE5R-OX40L-TK(−)"; "MVAΔE5R-hFlt3L-TK(−)"). In some embodiments, MVAΔE5R encompasses a recombinant MVA virus in which all or a majority of the E5R gene sequence is replaced by a first specific gene of interest (e.g., hFlt3L) and a second gene of interest (e.g., OX40L) is inserted into the TK locus ("MVAΔE5R-hFlt3L-TK(−)-OX40L"). In some embodiments, the engineered MVAΔE5R viruses of the present technology are modified to express at least one heterologous gene, such as any one or more of hOX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L (where "h" or "hu" designates the human protein), and/or include at least one further viral gene mutation or deletion, such as any one or more of the following deletions: E3L (ΔE3L); E3LΔ83N; C7L (ΔC7L); B2R (ΔB2R), B19R (B18R; ΔWR200); E5R; K7R; C12L (IL18BP); B8R; B14R; N1L; C11R; K1L; M1L; N2L; and/or WR199. In other embodiments, the MVAΔE5R viruses of the present technology contain no further heterologous genes and/or viral gene mutations other than those specifically referred to in the name of the virus.

The term "MVAΔWR199," is used herein to refer to a modified vaccinia Ankara (MVA) mutant virus or a vaccine comprising the virus, in which the WR199 gene is not expressed, expressed at levels so low as to have no effect, or the expressed protein is non-functional (e.g., is a null-mutation). As used herein, "MVAΔWR199" includes a deletion mutant of MVA which lacks a functional WR199 gene and is infective but non-replicative and it is further impaired in its ability to evade the host's immune system. As used herein, "MVAΔWR199" encompasses a recombinant MVA virus that does not express a functional E5 protein. In some embodiments, the ΔWR199 mutant includes a heterologous nucleic acid sequence in place of all or a majority of the WR199 gene sequence. For example, as used herein, "MVAΔWR199" encompasses a recombinant MVA nucleic acid sequence, wherein the nucleic acid sequence corresponding to the position of WR199 in the MVA genome (e.g., position 158,399 to 160,143 of the sequence set forth in GenBank Accession No. AY603355) is replaced with a heterologous nucleic acid sequence comprising an open reading frame that encodes a specific gene of interest (SG), such as human OX40L ("MVAΔWR199-OX40L") or human Fms-like tyrosine kinase 3 ligand (hFlt3L) ("MVAΔWR199-hFlt3L"). In some embodiments, MVAΔWR199 encompasses a recombinant MVA wherein the WR199 locus is modified to express one or more heterologous genes. For example, in some embodiments, MVAΔWR199 encompasses a recombinant MVA in which all or a majority of the WR199 gene sequence is replaced by a first specific gene of interest (e.g., hFtl3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as "MVAΔWR199-hFlt3L-OX40L." In some embodiments, the heterologous nucleic acid sequence comprises an open reading frame that encodes a selectable marker. In some embodiments, the selectable marker is a fluorescent protein (e.g., gpt, GFP, mCherry). In some embodiments, the MVAΔWR199 virus encompasses a recombinant MVA virus that does not express a functional thymidine kinase (TK) protein. In some embodiments, a specific gene of interest (e.g., OX40L, hFlt3L) is inserted into the TK locus of the MVA genome (e.g., position 75,560 to 76,093 of SEQ ID NO: 1), splitting the TK gene and obliterating it ("MVAΔWR199-OX40L-TK(−)"; "MVAΔWR199-hFlt3L-TK(−)"). In some embodiments, MVAΔWR199 encompasses a recombinant MVA virus in which all or a majority of the WR199 gene sequence is replaced by a first specific gene of interest (e.g., hFlt3L) and a second gene of interest (e.g., OX40L) is inserted into the TK locus ("MVAΔWR199-hFlt3L-TK(−)-OX40L"). In some embodiments, the engineered MVAΔWR199 viruses of the present technology are modified to express at least one heterologous gene, such as any one or more of hOX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L (where "h" or "hu" designates the human protein), and/or include at least one further viral gene mutation or deletion, such as any one or more of the following deletions: E3L (ΔE3L); E3LΔ83N; C7L (ΔC7L); B2R (ΔB2R), B19R (B18R; ΔWR200); E5R; K7R; C12L (IL18BP); B8R; B14R; N1L; C11R; K1L; M1L; and/or N2L. In other embodiments, the MVAΔWR199 viruses of the present technology contain no further heterologous genes and/or viral gene mutations other than those specifically referred to in the name of the virus.

The term "VACVΔC7L," is used herein to refer to a vaccinia mutant virus or vaccine comprising the virus in which the C7 gene is not expressed, expressed at levels so low as to have no effect, or the expressed protein is non-functional (e.g., is a null-mutation). As used herein, "VACVΔC7L" encompasses a recombinant vaccinia virus (VACV) that does not express a functional C7 protein. In some embodiments, the vaccinia virus is derived from the Western Reserve (WR) strain. In some embodiments, the ΔC7L mutant includes a heterologous sequence in place of all or a majority of the C7L gene sequence. For example, as used herein, "VACVΔC7L" encompasses a recombinant vaccinia virus nucleic acid sequence, wherein the nucleic acid sequence corresponding to the position of C7 in the VACV genome (e.g., position 15,716 to 16,168 of SEQ ID NO: 2) is replaced with a heterologous nucleic acid sequence comprising an open reading frame that encodes a specific gene of interest (SG), such as human OX40L ("VACVΔC7L-OX40L") or human Fms-like tyrosine kinase 3 ligand (hFlt3L) gene ("VACVΔC7L-hFlt3L"). In some embodiments, the heterologous nucleic acid sequence comprises an open reading frame that encodes a selectable marker. In some embodiments, the selectable marker is a fluorescent protein (e.g., gpt, GFP, mCherry). In some embodiments, the VACVΔC7L virus encompasses a recombinant vaccinia virus that does not express a functional thymidine kinase (TK) protein. In some embodiments, a specific gene of interest (e.g., OX40L, hFlt3L) is inserted into the TK locus (e.g., position 80,962 to 81,032 of SEQ ID NO: 2), splitting the TK gene and obliterating it ("VACVΔC7L-OX40L-TK(−)"; "VACVΔC7L-hFlt3L-TK (−)"). In some embodiments, VACVΔC7L encompasses a recombinant vaccinia virus in which all or a majority of the C7L gene sequence is replaced by a first specific gene of interest (e.g., hFlt3L) and a second gene of interest (e.g., OX40L) is inserted into the TK locus ("VACVΔC7L-hFlt3L-TK(−)-OX40L"). In some embodiments, the recombinant VACVΔC7L-OX40L viruses of the present technology are further modified to express at least one additional heterologous gene, such as any one or more of hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one viral gene mutation or deletion, such as any one or more of the following vaccinia viral deletions: E3L (ΔE3L); E3LΔ83N; B2R (ΔB2R), B19R (B18R; ΔWR200); E5R; K7R; C12L (IL18BP); B8R; B14R; N1L; C11R; K1L; M1L; N2L; and/or WR199. For example, in some embodiments, the disclosure of the present technology provides a recombinant VACVΔ E3L83N-hFlt3L-anti-CTLA-4-ΔC7L-OX40L virus. In other embodiments, the recombinant VACVΔC7L-OX40L viruses of the present technology do not express any further heterologous genes and/or do not include any additional viral gene mutations or deletions other than those specifically indicated in the name of the virus.

The term "VACVΔE5R," is used herein to refer to a vaccinia mutant virus or vaccine comprising the virus in which the E5R gene is not expressed, expressed at levels so low as to have no effect, or the expressed protein is non-functional (e.g., is a null-mutation). As used herein, "VACVΔE5R" encompasses a recombinant vaccinia virus (VACV) that does not express a functional E5 protein. In some embodiments, the vaccinia virus is derived from the Western Reserve (WR) strain. In some embodiments, the ΔE5R mutant includes a heterologous sequence in place of all or a majority of the E5R gene sequence. For example, as used herein, "VACVΔE5R" encompasses a recombinant vaccinia virus nucleic acid sequence, wherein the nucleic acid sequence corresponding to the position of E5R in the VACV genome (e.g., position 49,236 to 50,261 of SEQ ID NO: 2) is replaced with a heterologous nucleic acid sequence comprising an open reading frame that encodes a specific gene of interest (SG), such as human OX40L ("VACVΔE5R-OX40L") or human Fms-like tyrosine kinase 3 ligand (hFlt3L) gene ("VACVΔE5R-hFlt3L"). In some embodiments, the heterologous nucleic acid sequence comprises an open reading frame that encodes a selectable marker. In some embodiments, the selectable marker is a fluorescent protein (e.g., gpt, GFP, mCherry). In some embodiments, the VACVΔE5R virus encompasses a recombinant vaccinia virus that does not express a functional thymidine kinase (TK) protein. In some embodiments, a specific gene of interest (e.g., OX40L, hFlt3L) is inserted into the TK locus (e.g., position 80,962 to 81,032 of SEQ ID NO: 2), splitting the TK gene and obliterating it ("VACVΔE5R-OX40L-TK(−)"; "VACVΔE5R-hFlt3L-TK (−)"). In some embodiments, VACVΔE5R encompasses a recombinant vaccinia virus in which all or a majority of the E5R gene sequence is replaced by a first specific gene of interest (e.g., hFlt3L) and a second gene of interest (e.g., OX40L) is inserted into the TK locus ("VACVΔE5R-hFlt3L-TK(−)-OX40L"). In some embodiments, the engineered VACVΔE5R viruses of the present technology are modified to express at least one heterologous gene, such as any one or more of hOX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one viral gene mutation or deletion, such as any one or more of the following vaccinia viral deletions: E3L (ΔE3L); E3LΔ83N; C7L (ΔC7L); B2R (ΔB2R), B19R (B18R; ΔWR200); E5R; K7R; C12L (IL18BP); B8R; B14R; N1L; C11R; K1L; M1L; N2L; and/or WR199. For example, in some embodiments, the disclosure of the present technology provides a recombinant VACVΔE3L-hFlt3L-anti-CTLA-4-OX40L-ΔE5R virus. As another example, in some embodiments, the TK locus of the vaccinia genome is modified through homologous recombination to express both the heavy and light chain of an antibody, such as anti-CTLA-4, wherein the coding sequences of the heavy chain and light chain are separated by a cassette including a furin cleavage site followed by a 2A peptide (Pep2A) sequence to produce VACV-TK(−)-anti-CTLA-4. In some embodiments, the VACV-TK(−)-anti-CTLA-4 genome is further modified to comprise a deletion of E5R, in which all or a majority of the E5R gene sequence is replaced by a first specific gene of interest (e.g., hFlt3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as VACV-$TK^-$-anti-CTLA-4-$E5R^-$-hFlt3L-OX40L (or VACVΔE5R-TK(−)-anti-CTLA-4-hFlt3L-OX40L). In other embodiments, the VACVΔE5R viruses of the present technology do not express any further heterologous genes and/or do not include any additional viral gene mutations or deletions other than those specifically indicated in the name of the virus.

The term "VACVΔB2R," is used herein to refer to a vaccinia mutant virus or vaccine comprising the virus in which the B2R gene is not expressed, expressed at levels so low as to have no effect, or the expressed protein is non-functional (e.g., is a null-mutation). As used herein, "VACVΔB2R" encompasses a recombinant vaccinia virus (VACV) that does not express a functional B2 protein. In some embodiments, the vaccinia virus is derived from the Western Reserve (WR) strain. In some embodiments, the ΔB2R mutant includes a heterologous sequence in place of all or a majority of the B2R gene sequence. For example, as used herein, "VACVΔB2R" encompasses a recombinant vaccinia virus nucleic acid sequence, wherein the nucleic acid sequence corresponding to the position of B2R in the VACV genome (e.g., position 164,856 to 165,530 of SEQ ID NO: 2) is replaced with a heterologous nucleic acid sequence comprising an open reading frame that encodes a specific gene of interest (SG), such as human OX40L ("VACVΔB2R-OX40L") or human Fms-like tyrosine kinase 3 ligand (hFlt3L) gene ("VACVΔB2R-hFlt3L"). In some embodiments, the heterologous nucleic acid sequence comprises an open reading frame that encodes a selectable marker. In some embodiments, the selectable marker is a fluorescent protein (e.g., gpt, GFP, mCherry). In some embodiments, the VACVΔB2R virus encompasses a recombinant vaccinia virus that does not express a functional thymidine kinase (TK) protein. In some embodiments, a specific gene of interest (e.g., OX40L, hFlt3L) is inserted into the TK locus (e.g., position 80,962 to 81,032 of SEQ ID NO: 2), splitting the TK gene and obliterating it ("VACVΔB2R-OX40L-TK(−)"; "VACVΔB2R-hFlt3L-TK(−)"). In some embodiments, VACVΔB2R encompasses a recombinant vaccinia virus in which all or a majority of the B2R gene sequence is replaced by a first specific gene of interest (e.g., hFlt3L) and a second gene of interest (e.g., OX40L) is inserted into the TK locus ("VACVΔB2R-hFlt3L-TK(−)-OX40L"). In some embodiments, the engineered VACVΔB2R viruses of the present technology are modified to express at least one heterologous gene, such as any one or more of hOX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one viral gene mutation or deletion, such as any one or more of the following vaccinia viral deletions: E3L (ΔE3L); E3LΔ83N; C7L (ΔC7L); B19R (B18R; ΔWR200); E5R; K7R; C12L (IL18BP); B8R; B14R; N1L; C11R; K1L; M1L; N2L; and/or WR199. As another example, in some embodiments, the TK locus of the vaccinia genome is modified through homologous recombination to express both the heavy and light chain of an antibody, such as anti-CTLA-4, wherein the coding sequences of the heavy chain and light chain are separated by a cassette including a furin cleavage site followed by a 2A peptide (Pep2A) sequence to produce VACV-TK(−)-anti-CTLA-4. In some embodiments, the VACV-TK(−)-anti-CTLA-4 genome is further modified to comprise a deletion of B2R, in which all or a majority of the B2R gene sequence is replaced by a first specific gene of interest (e.g., hFlt3L) and a second specific gene of interest (e.g., OX40L), wherein the coding sequences of the first and second specific genes of interest are separated by a cassette including a furin cleavage site followed by a 2A peptide (Pep2A) sequence. In other embodiments, the VACVΔB2R viruses of the present technology do not express any further heterologous genes and/or do not include any additional viral gene mutations or deletions other than those specifically indicated in the name of the virus.

The term "MYXVΔM31R," is used herein to refer to a myxoma mutant virus or vaccine comprising the virus in which the M31R gene is not expressed, expressed at levels so low as to have no effect, or the expressed protein is non-functional (e.g., is a null-mutation). Myxoma virus M31R is the ortholog of the vaccinia virus E5R. As used herein, "MYXVΔM31R" encompasses a recombinant myxoma virus (MYXV) that does not express a functional M31R protein. In some embodiments, the ΔM31R mutant includes a heterologous sequence in place of all or a majority of the M31R gene sequence. For example, as used herein, "MYXVΔM31R" encompasses a recombinant myxoma virus nucleic acid sequence, wherein the nucleic acid sequence corresponding to the position of M31R in the MYXV genome (e.g., position 30,138 to 31,319 of the MYXV genome) is replaced with a heterologous nucleic acid sequence comprising an open reading frame that encodes a specific gene of interest (SG), such as human OX40L ("MYXVΔM31R-OX40L") or human Fms-like tyrosine kinase 3 ligand (hFlt3L) gene ("MYXVΔM31R-hFlt3L"). In some embodiments, MYXVΔM31R encompasses a recombinant MYXV wherein the M31R locus is modified to express one or more heterologous genes. For example, in some embodiments, MYXVΔM31R encompasses a recombinant MYXV in which all or a majority of the M31R gene sequence is replaced by a first specific gene of interest (e.g., hFtl3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as "MYXVΔM31R-hFlt3L-OX40L." In some embodiments, the heterologous nucleic acid sequence further comprises an open reading frame that encodes a selectable marker. In some embodiments, the selectable marker is a fluorescent protein (e.g., gpt, GFP, mCherry). In some embodiments, the MYXVΔM31R virus encompasses a recombinant myxoma virus that does not express a functional thymidine kinase (TK) protein. In some embodiments, a specific gene of interest (e.g., OX40L, hFlt3L) is inserted into the TK locus (e.g., position 57,797 to 58,333 of the myxoma genome), splitting the TK gene and obliterating it ("MYXVΔM31R-OX40L-TK(−)"; "MYXVΔM31R-hFlt3L-TK(−)"). In some embodiments, MYXVΔM31R encompasses a recombinant myxoma virus in which all or a majority of the M31R gene sequence is replaced by a first specific gene of interest (e.g., hFlt3L) and a second gene of interest (e.g., OX40L) is inserted into the TK locus ("MYXVΔM31R-hFlt3L-TK(−)-OX40L"). In some embodiments, the engineered MYXVΔM31R viruses of the present technology are modified to express at least one heterologous gene, such as any one or more of hOX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one viral gene mutation or deletion, such as any one or more of the following myxoma orthologs of vaccinia viral deletions: E3L (ΔE3L); E3LΔ83N; C7L (ΔC7L); B2R (ΔB2R), B19R (B18R; ΔWR200); K7R; C12L (IL18BP); B8R; B14R; N1L; C11R; K1L; M1L; N2L; and/or WR199. In other embodiments, the MYXVΔM31R viruses of the present technology do not express any further heterologous genes and/or do not include any additional viral gene mutations or deletions other than those specifically indicated in the name of the virus.

The term "MYXVΔM63R," is used herein to refer to a myxoma mutant virus or vaccine comprising the virus in which the M63R gene is not expressed, expressed at levels so low as to have no effect, or the expressed protein is non-functional (e.g., is a null-mutation). As used herein, "MYXVΔM63R" encompasses a recombinant myxoma virus (MYXV) that does not express a functional M63R protein. In some embodiments, the ΔM63R mutant includes a heterologous sequence in place of all or a majority of the M63R gene sequence. For example, as used herein, "MYXVΔM63R" encompasses a recombinant myxoma virus nucleic acid sequence, wherein the nucleic acid sequence corresponding to the position of M63R in the MYXV genome is replaced with a heterologous nucleic acid sequence comprising an open reading frame that encodes a specific gene of interest (SG), such as human OX40L ("MYXVΔM63R-OX40L") or human Fms-like tyrosine kinase 3 ligand (hFlt3L) gene ("MYXVΔM63R-hFlt3L"). In some embodiments, MYXVΔM63R encompasses a recombinant MYXV wherein the M63R locus is modified to express one or more heterologous genes. For example, in some embodiments, MYXVΔM63R encompasses a recombinant MYXV in which all or a majority of the M63R gene sequence is replaced by a first specific gene of interest (e.g., hFtl3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as "MYXVΔM63R-hFlt3L-OX40L." Additinally or alternatively, in some embodiments, the heterologous nucleic acid sequence comprises an open reading frame that encodes a selectable marker. In some embodiments, the selectable marker is a fluorescent protein (e.g., gpt, GFP, mCherry). In some embodiments, the MYXVΔM63R virus encompasses a recombinant myxoma virus that does not express a functional thymidine kinase (TK) protein. In some embodiments, a specific gene of interest (e.g., OX40L, hFlt3L) is inserted into the TK locus (e.g., position 57,797 to 58,333 of the myxoma genome), splitting the TK gene and obliterating it ("MYXVΔM63R-OX40L-TK(−)"; "MYXVΔM63R-hFlt3L-TK(−)"). In some embodiments, MYXVΔM63R encompasses a recombinant myxoma virus in which all or a majority of the M63R gene sequence is replaced by a first specific gene of interest (e.g., hFlt3L) and a second gene of interest (e.g., OX40L) is inserted into the TK locus ("MYXVΔM63R-hFlt3L-TK(−)-OX40L"). In some embodiments, the engineered MYXVΔM63R viruses of the present technology are modified to express at least one heterologous gene, such as any one or more of hOX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one viral gene mutation or deletion, such as any one or more of the following myxoma orthologs of vaccinia viral deletions: E3L (ΔE3L); E3LΔ83N; C7L (ΔC7L); B2R (ΔB2R), B19R (B18R; ΔWR200); K7R; C12L (IL18BP); B8R; B14R; N1L; C11R; K1L; M1L; N2L; and/or WR199. In some embodiments, MYXVΔM63R is further engineered to comprise additional myxoma gene deletions (e.g., ΔM31R, ΔM62R, and/or ΔM64R). In other embodiments, the MYXVΔM63R viruses of the present technology do not express any further heterologous genes and/or do not include any additional viral gene mutations or deletions other than those specifically indicated in the name of the virus.

The term "MYXVΔM64R," is used herein to refer to a myxoma mutant virus or vaccine comprising the virus in which the M64R gene is not expressed, expressed at levels so low as to have no effect, or the expressed protein is non-functional (e.g., is a null-mutation). As used herein, "MYXVΔM64R" encompasses a recombinant myxoma virus (MYXV) that does not express a functional M64R protein. In some embodiments, the ΔM64R mutant includes a heterologous sequence in place of all or a majority of the M64R gene sequence. For example, as used herein, "MYXVΔM64R" encompasses a recombinant myxoma virus nucleic acid sequence, wherein the nucleic acid sequence corresponding to the position of M64R in the MYXV genome is replaced with a heterologous nucleic acid sequence comprising an open reading frame that encodes a specific gene of interest (SG), such as human OX40L ("MYXVΔM64R-OX40L") or human Fms-like tyrosine kinase 3 ligand (hFlt3L) gene ("MYXVΔM64R-hFlt3L"). In some embodiments, MYXVΔM64R encompasses a recombinant MYXV wherein the M64R locus is modified to express one or more heterologous genes. For example, in some embodiments, MYXVΔM64R encompasses a recombinant MYXV in which all or a majority of the M64R gene sequence is replaced by a first specific gene of interest (e.g., hFtl3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as "MYXVΔM64R-hFlt3L-OX40L." Additinally or alternatively, in some embodiments, the heterologous nucleic acid sequence comprises an open reading frame that encodes a selectable marker. In some embodiments, the selectable marker is a fluorescent protein (e.g., gpt, GFP, mCherry). In some embodiments, the MYXVΔM64R virus encompasses a recombinant myxoma virus that does not express a functional thymidine kinase (TK) protein. In some embodiments, a specific gene of interest (e.g., OX40L, hFlt3L) is inserted into the TK locus (e.g., position 57,797 to 58,333 of the myxoma genome), splitting the TK gene and obliterating it ("MYXVΔM64R-OX40L-TK(−)"; "MYXVΔM64R-hFlt3L-TK(−)"). In some embodiments, MYXVΔM64R encompasses a recombinant myxoma virus in which all or a majority of the M64R gene sequence is replaced by a first specific gene of interest (e.g., hFlt3L) and a second gene of interest (e.g., OX40L) is inserted into the TK locus ("MYXVΔM64R-hFlt3L-TK(−)-OX40L"). In some embodiments, the engineered MYXVΔM64R viruses of the present technology are modified to express at least one heterologous gene, such as any one or more of hOX40L, hFlt3L, hIL-2, hIL-12, hIL-15, hIL-15/IL-15RΔ, hIL-18, hIL-21, anti-huCTLA-4, anti-huPD-1, anti-huPD-L1, GITRL, 4-1BBL, or CD40L, and/or include at least one viral gene mutation or deletion, such as any one or more of the following myxoma orthologs of vaccinia viral deletions: E3L (ΔE3L); E3LΔ83N; C7L (ΔC7L); B2R (ΔB2R), B19R (B18R; ΔWR200); K7R; C12L (IL18BP); B8R; B14R; N1L; C11R; K1L; M1L; N2L; and/or WR199. In some embodiments, MYXVΔM64R is further engineered to comprise additional myxoma gene deletions (e.g., ΔM31R, ΔM62R, and/or ΔM63R). In other embodiments, the MYXVΔM64R viruses of the present technology do not express any further heterologous genes and/or do not include any additional viral gene mutations or deletions other than those specifically indicated in the name of the virus.

As used herein, "oncolytic virus" refers to a virus that preferentially infects cancer cells, replicates in such cells, and induces lysis of the cancer cells through its replication process. Nonlimiting examples of naturally occurring oncolytic viruses include vesicular stomatitis virus, reovirus, as well as viruses engineered to be oncoselective such as adenovirus, Newcastle disease virus and herpes simplex virus (See, e.g., Nemunaitis, *J. Invest. New Drugs* 17(4): 375-86 (1999); Kirn, DH et al., *Nat. Rev. Cancer* 9(1):64-71(2009); Kirn et al., *Nat. Med.* 7:781 (2001); Coffey et al., *Science* 282:1332 (1998)). Vaccinia virus infects many types of cells but replicates preferentially in tumor cells due to the fact that tumor cells have a metabolism that favors replication, exhibit activation of certain pathways that also favor replication and create an environment that evades the innate immune system, which also favors viral replication.

As used herein, "parenteral," when used in the context of administration of a therapeutic substance or composition, includes any route of administration other than administration through the alimentary tract. Particularly relevant for the methods disclosed herein are intravenous (including, for example, through the hepatic portal vein for hepatic delivery), intratumoral, or intrathecal administration.

The terms "pharmaceutically acceptable excipient," "pharmaceutically acceptable diluent," "pharmaceutically acceptable carrier," or "pharmaceutically acceptable adjuvant" refer to an excipient, diluent, carrier, and/or adjuvant useful in preparing a pharmaceutical composition that is generally safe, non-toxic and neither biologically nor otherwise undesirable, and includes an excipient, diluent, carrier, and adjuvant that is acceptable for pharmaceutical use. "A pharmaceutically acceptable excipient, diluent, carrier and/or adjuvant" as used in the specification and claims includes one and more such excipients, diluents, carriers, and adjuvants.

As used herein, "prevention," "prevent," or "preventing" of a disorder or condition refers to one or more compounds that, in a statistical sample, reduces the occurrence of the disorder or condition in the treated sample relative to an untreated control sample, or delays the onset of one or more symptoms of the disorder or condition relative to the untreated control sample.

As used herein, the term "recombinant" when used with reference, e.g., to a virus, or cell, or nucleic acid, or protein, or vector, indicates that the virus, cell, nucleic acid, protein or vector, has been modified by the introduction of a heterologous nucleic acid or protein or the alteration of a native nucleic acid or protein, or that the material is derived from a virus or cell so modified. Thus, for example, recombinant viruses or cells express genes that are not found within the native (non-recombinant) form of the virus or cell or express native genes that are otherwise abnormally expressed, under expressed or not expressed at all.

As used herein, "solid tumor" refers to all neoplastic cell growth and proliferation, and all pre-cancerous and cancerous cells and tissues, except for hematologic cancers such as lymphomas, leukemias, and multiple myeloma. Examples of solid tumors include, but are not limited to: soft tissue sarcoma, such as fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor and other bone tumors (e.g., osteosarcoma, malignant fibrous histiocytoma), leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, bladder carcinoma, epithelial carcinoma, brain/CNS tumors (e.g., astrocytoma, glioma, glioblastoma, childhood tumors, such as atypical teratoid/rhabdoid tumor, germ cell tumor, embryonal tumor, ependymoma) medulloblastoma, craniopharyngioma, ependymoma, pinealoma, hemangioblastoma, acoustic neuroma, oligodendroglioma, meningioma, melanoma, neuroblastoma, and retinoblastoma. Some of the most common solid tumors for which the compositions and methods of the present disclosure would be useful include: head-and-neck cancer, rectal adenocarcinoma, glioma, medulloblastoma, urothelial carcinoma, pancreatic adenocarcinoma, uterine (e.g., endometrial cancer, fallopian tube cancer) ovarian cancer, cervical cancer prostate adenocarcinoma, non-small cell lung cancer (squamous and adenocarcinoma), small cell lung cancer, melanoma, breast carcinoma, bladder cancer, ductal carcinoma in situ, renal cell carcinoma, and hepatocellular carcinoma, adrenal tumors (e.g., adrenocortical carcinoma), esophageal, eye (e.g., melanoma, retinoblastoma), gallbladder, gastrointestinal, Wilms' tumor, heart, head and neck, laryngeal and hypopharyngeal, oral (e.g., lip, mouth, salivary gland), nasopharyngeal, neuroblastoma, peritoneal, pituitary, Kaposi's sarcoma, small intestine, stomach, testicular, thymus, thyroid, parathyroid, vaginal tumor, and the metastases of any of the foregoing.

As used herein, the terms "subject," "individual," or "patient" are used interchangeably herein, and can be an individual organism, a vertebrate, a mammal, or a human. In some embodiments, "subject" means any animal (mammalian, human, or other) patient that can be afflicted with cancer and when thus afflicted is in need of treatment. In some embodiments, "subject" means human.

As used herein, a "synergistic therapeutic effect" in some embodiments reflects a greater-than-additive therapeutic effect that is produced by a combination of at least two agents, and which exceeds that which would otherwise result from the individual administration of the agents. In some embodiments, a "synergistic therapeutic effect" reflects an enhanced therapeutic effect that is produced by a combination of at least two agents relative to the individual administration of the agents. For example, lower doses of one or more agents may be used in treating a disease or disorder, resulting in increased therapeutic efficacy and decreased side-effects.

"Treating," "treat," "treated," or "treatment" as used herein covers the treatment of a disease or disorder described herein, in a subject, such as a human, and includes: (i) inhibiting a disease or disorder, i.e., arresting its development; (ii) relieving a disease or disorder, i.e., causing regression of the disorder; (iii) slowing progression of the disorder; and/or (iv) inhibiting, relieving, or slowing progression of one or more symptoms of the disease or disorder. In some embodiments, treatment means that the symptoms associated with the disease are, e.g., alleviated, reduced, cured, or placed in a state of remission. In some embodiments, "inhibiting," means reducing or slowing the growth of a tumor. In some embodiments, the inhibition of tumor growth may be, for example, by 5% or more, 10% or more, 20% or more, 30% or more, 40% or more, 50% or more, 60% or more, 70% or more, 80% or more, or 90% or more. In some embodiments, the inhibition may be complete.

It is also to be appreciated that the various modes of treatment or prevention of medical diseases and conditions as described are intended to mean "substantial," which includes total but also less than total treatment or prevention, and wherein some biologically or medically relevant result is achieved.

As used herein, "tumor immunity" refers to one or more processes by which tumors evade recognition and clearance by the immune system. Thus, as a therapeutic concept, tumor immunity is "treated" when such evasion is attenuated or eliminated, and the tumors are recognized and attacked by the immune system (the latter being termed herein "anti-tumor immunity"). An example of tumor recognition is tumor binding, and examples of tumor attack are tumor reduction (in number, size, or both) and tumor clearance.

As used herein, "T-cell" refers to a thymus derived lymphocyte that participates in a variety of cell-mediated adaptive immune reactions. As used herein, "effector T-cell" includes helper, killer, and regulatory T-cells.

As used herein, "helper T-cell" refers to a $CD4^+$ T-cell; helper T-cells recognize antigen bound to MHC Class II molecules. There are at least two types of helper T-cells, Th1 and Th2, which produce different cytokines.

As used herein, "cytotoxic T-cell" refers to a T-cell that usually bears CD8 molecular markers on its surface ($CD8^+$) and that functions in cell-mediated immunity by destroying a target T-cell having a specific antigenic molecule on its surface. Cytotoxic T-cells also release Granzyme, a serine protease that can enter target T-cells via the perforin-formed pore and induce apoptosis (cell death). Granzyme serves as a marker of cytotoxic phenotype. Other names for cytotoxic T-cell include CTL, cytolytic T-cell, cytolytic T lymphocyte, killer T-cell, or killer T lymphocyte. Targets of cytotoxic T-cells may include virus-infected cells, cells infected with bacterial or protozoal parasites, or cancer cells. Most cytotoxic T-cells have the protein CD8 present on their cell surfaces. CD8 is attracted to portions of the Class I MHC molecule. Typically, a cytotoxic T-cell is a $CD8^+$ cell.

As used herein, "tumor-infiltrating leukocytes" refers to white blood cells of a subject afflicted with a cancer (such as melanoma), that are resident in or otherwise have left the circulation (blood or lymphatic fluid) and have migrated into a tumor.

As used herein, "vector" includes any genetic element, such as a plasmid, phage, transposon, cosmid, chromosome, artificial chromosome, virus, virion, etc., which is capable of replication when associated with the proper control elements and which can transfer gene sequences between cells. Thus, the term includes cloning and expression vehicles, as well as viral vectors. In some embodiments, useful vectors are contemplated to be those vectors in which the nucleic acid segment to be transcribed is positioned under the transcriptional control of a promoter. A "promoter" refers to a DNA sequence recognized by the synthetic machinery of the cell, or introduced synthetic machinery, required to initiate the specific transcription of a gene. The phrases "operatively positioned," "operatively linked," "under control," or "under transcriptional control" means that the promoter is in the correct location and orientation in relation to the nucleic acid to control RNA polymerase initiation and expression of the gene. The term "expression vector or construct" means any type of genetic construct containing a nucleic acid in which part or all of the nucleic acid encoding sequence is capable of being transcribed. In some embodiments, expression includes transcription of the nucleic acid, for example, to generate a biologically-active polypeptide product or inhibitory RNA (e.g., shRNA, miRNA) from a transcribed gene. A non-limiting example of a pCB-OX40L-gpt vector according to the present technology is set forth in SEQ ID NO: 3. A non-limiting example of a pUC57-hFlt3L-GFP vector according to the present technology is set forth in SEQ ID NO: 4. A non-limiting example of a pUC57-delC7-hOX40L-mCherry vector is set forth in SEQ ID NO: 5.

The term "virulence" as used herein to refer to the relative ability of a pathogen to cause disease. The term "attenuated virulence" or "reduced virulence" is used herein to refer to a reduced relative ability of a pathogen to cause disease.

II. Immune System and Cancer

Malignant tumors are inherently resistant to conventional therapies and present significant therapeutic challenges. Immunotherapy has become an evolving area of research and an additional option for the treatment of certain types of cancers. The immunotherapy approach rests on the rationale that the immune system may be stimulated to identify tumor cells and target them for destruction.

Numerous studies support the importance of the differential presence of immune system components in cancer progression (Jochems et al., *Exp. Biol. Med.* 236(5):567-579 (2011)). Clinical data suggest that high densities of tumor-infiltrating lymphocytes are linked to improved clinical outcome (Mlecnik et al., *Cancer Metastasis Rev.* 30:5-12, (2011)). The correlation between a robust lymphocyte infiltration and patient survival has been reported in various types of cancer, including melanoma, ovarian, head and neck, breast, bladder, urothelial, colorectal, lung, hepatocellular, gallbladder, and esophageal cancer (Angell et al., *Current Opinion in Immunology* 25:1-7, (2013)). Tumor immune infiltrates include macrophages, dendritic cells (DC), monocytes, neutrophils, natural killer (NK) cells, naïve and memory lymphocytes, B cells and effector T-cells (T lymphocytes), primarily responsible for the recognition of antigens expressed by tumor cells and subsequent destruction of the tumor cells by cytotoxic T-cells.

Despite presentation of antigens by cancer cells and the presence of immune cells that could potentially react against tumor cells, in many cases the immune system does not get activated or is affirmatively suppressed. Key to this phenomenon is the ability of tumors to protect themselves from immune response by coercing cells of the immune system to inhibit other cells of the immune system. Tumors develop a number of immunomodulatory mechanisms to evade antitumor immune responses. For example, tumor cells secrete immune inhibitory cytokines (such as TGF-β) or induce immune cells, such as $CD4^+$ T regulatory cells and macrophages, in tumor lesions to secrete these cytokines. Tumors also have the ability to bias $CD4^+$ T-cells to express the regulatory phenotype. The overall result is impaired T-cell responses and impaired induction of apoptosis or reduced anti-tumor immune capacity of $CD8^+$ cytotoxic T-cells. Additionally, tumor-associated altered expression of MHC class I on the surface of tumor cells makes them "invisible" to the immune response (Garrido et al. *Cancer Immunol. Immunother.* 59(10):1601-1606 (2010)). Inhibition of antigen-presenting functions and dendritic cell (DC) additionally contributes to the evasion of anti-tumor immunity (Gerlini et al. *Am. J. Pathol.* 165(6):1853-1863 (2004)).

Moreover, the local immunosuppressive nature of the tumor microenvironment, along with immune editing, can lead to the escape of cancer cell subpopulations that do not express the target antigens. Thus, finding an approach that would promote the preservation and/or restoration of antitumor activities of the immune system would be of considerable therapeutic benefit.

Immune checkpoints have been implicated in the tumor-mediated downregulation of anti-tumor immunity and used as therapeutic targets. It has been demonstrated that T-cell dysfunction occurs concurrently with an induced expression of the inhibitory receptors, CTLA-4 and programmed death 1 polypeptide (PD-1), members of the CD28 family of receptors. PD-1 is an inhibitory member of the CD28 family of receptors that in addition to PD-1 includes CD28, CTLA-4, ICOS, and BTLA. However, while promise regarding the use of immunotherapy in the treatment of melanoma has been underscored by the clinical use and even regulatory approval of anti-CTLA-4 (ipilimumab) and anti-PD-1 drugs (e.g., pembrolizumab and nivolumab), the response of patients to these immunotherapies has been limited. Clinical trials, focused on blocking these inhibitory signals in T-cells (e.g., CTLA-4, PD-1, and the ligand of PD-1, PD-L1), have shown that reversing T-cell suppression is critical for successful immunotherapy (Sharma et al., *Science* 348(6230): 56-61 (2015); Topalian et al., *Curr. Opin. Immunol.* 24(2): 202-217 (2012)). These observations highlight the need for development of novel therapeutic approaches for harnessing the immune system against cancer.

III. Poxviruses: Vaccinia Virus (VACV), Modified Vaccinia Ankara (MVA) Virus, and Myxoma Virus (MYXV)

Poxviruses, such as engineered vaccinia viruses, are in the forefront as oncolytic therapy for metastatic cancers (Kirn et al., *Nature Review Cancer* 9:64-71 (2009)). Vaccinia viruse (VACV), a member of the Poxvirus family, is a large DNA virus, which has a rapid life cycle and efficient hematogenous spread to distant tissues. Poxviruses are well-suited as vectors to express multiple transgenes in cancer cells and thus to enhance therapeutic efficacy (Breitbach et al., *Current pharmaceutical biotechnology* 13:1768-1772 (2012)). Preclinical studies and clinical trials have demonstrated efficacy of using oncolytic vaccinia viruses and other poxviruses for treatment of advanced cancers refractory to conventional therapy (Park et al., *Lacent Oncol.* 9:533-542 (2008); Kirn et al., *PLOS Med* 4: *e*353 (2007); Thorne et al., *J. Clin. Invest.* 117:3350-3358 (2007)). Poxvirus-based oncolytic therapy has the advantage of killing cancer cells through a combination of cell lysis, apoptosis, and necrosis. It also triggers innate immune sensing pathway that facilitates the recruitment of immune cells to the tumors and the development of anti-tumor adaptive immune responses. The current oncolytic vaccinia strains in clinical trials (JX-594, for example) are replicative strains. They use wild-type vaccinia with deletion of thymidine kinase to enhance tumor selectivity, and with expression of transgenes such as granulocyte macrophage colony stimulating factor (GM-CSF) to stimulate immune responses (Breitbach et al., *Curr. Pharm. Biotechnol.* 13:1768-1772 (2012)). Many studies have shown, however, that wild-type vaccinia has immune suppressive effects on antigen presenting cells (APCs) (Engelmayer et al., *J. Immunol.* 163:6762-6768 (1999); Jenne et al., *Gene Therapy* 7:1575-1583 (2000); P. Li et al., *J. Immunol.* 175:6481-6488 (2005); Deng et al., *J. Virol.* 80:9977-9987 (2006)), and thus adds to the immunosuppressive and immunoevasive effects of tumors themselves.

The vaccinia virus (Western Reserve strain; WR) genome sequence is set forth in SEQ ID NO: 2, and is given by GenBank Accession No. AY243312.1.

Modified Vaccinia Ankara (MVA) virus is also a member of the Poxvirus family. MVA was generated by approximately 570 serial passages on chicken embryo fibroblasts (CEF) of the Ankara strain of vaccinia virus (CVA) (Mayr et al., *Infection* 3:6-14 (1975)). As a consequence of these long-term passages, the resulting MVA virus contains extensive genome deletions and is highly host cell restricted to avian cells (Meyer et al., *J. Gen. Virol.* 72:1031-1038 (1991)). It was shown in a variety of animal models that the resulting MVA is significantly avirulent (Mayr et al., *Dev. Biol. Stand.* 41:225-34 (1978)).

The safety and immunogenicity of MVA has been extensively tested and documented in clinical trials, particularly against the human smallpox disease. These studies included over 120,000 individuals and have demonstrated excellent efficacy and safety in humans. Moreover, compared to other vaccinia based vaccines, MVA has weakened virulence (infectiousness) while it triggers a good specific immune response. Thus, MVA has been established as a safe vaccine vector, with the ability to induce a specific immune response.

Due to the above mentioned characteristics, MVA became an attractive candidate for the development of engineered MVA vectors, used for recombinant gene expression and vaccines. As a vaccine vector, MVA has been investigated against numerous pathological conditions, including HIV, tuberculosis and malaria, as well as cancer (Sutter et al., *Curr. Drug Targets Infect. Disord.* 3:263-271(2003); Gomez et al., *Curr. Gene Ther.* 8:97-120 (2008)).

It has been demonstrated that MVA infection of human monocyte-derived dendritic cells (DC) causes DC activation, characterized by the upregulation of co-stimulatory molecules and secretion of proinflammatory cytokines (Drillien et al., *J. Gen. Virol.* 85:2167-2175 (2004)). In this respect, MVA differs from standard wild type vaccinia virus (WT-VAC), which fails to activate DCs. Dendritic cells can be classified into two main subtypes: conventional dendritic cells (cDCs) and plasmacytoid dendritic cells (pDCs). The former, especially the $CD103^+/CD8\alpha^+$ subtype, are particularly adapted to cross-presenting antigens to T-cells; the latter are strong producers of Type I IFN.

Viral infection of human cells results in activation of an innate immune response (the first line of defense) mediated by type I interferons, notably interferon-alpha (α). This normally leads to activation of an immunological "cascade," with recruitment and proliferation of activated T-cells (both CTL and helper) and eventually with antibody production. However, viruses express factors that dampen immune responses of the host. MVA is a better immunogen than WT-VAC and replicates poorly in mammalian cells. (See, e.g., Brandler et al., *J. Virol.* 84:5314-5328 (2010)).

However, MVA is not entirely non-replicative and contains some residual immunosuppressive activity. Nevertheless, MVA has been shown to prolong survival of treated subjects.

The MVA genome sequence is set forth in SEQ ID NO: 1 and is given by GenBank Accession No. U94848.1.

Myxoma virus (MYXV) is the prototypic member of the Leporipoxvirus genus within the Poxviridae family. The MYXV Lausanne strain genome (given by, e.g., GenBank Accession No. AF170726.2) is 161.8 kbp in size, encoding about 171 genes. The central region of the genome encodes less than 100 genes that are highly conserved in all poxviruses while the terminal genomic regions are enriched for more unique genes that encode immunomodulatory and host-interactive factors that are involved in subverting the host immune system and other anti-viral responses. Myxoma virus exhibits a very restricted host range and is only pathogenic to European rabbits. Despite its narrow host range in nature, MYXV has been shown to productively infect various classes of human cancer cells. Attractive features of MYXV as an oncolytic agent include its ability to productively infect various human cancer cells and its consistent safety in all non-rabbit hosts tested, including mice and humans. In some embodiments, the myxoma virus is derived from strain Lausanne.

V. Vaccinia virus C7 protein and MVA or Vaccinia Virus comprising deletion of C7 (MVAΔC7L, VACVΔC7L), or Myxoma Virus comprising deletion of myxoma C7 orthologs Vaccinia virus C7 protein is an important host range factor for vaccinia virus life cycle in mammalian cells. C7L homologs are present in almost all of the poxviruses that infect mammalian hosts. Deletion of both host range gene C7L and K1L renders the virus incapable of replication in human cells (Perkus et al., *Virology,* 1990). The mutant virus deficient of both K1L and C7L gains its ability to replicate in human Hela cells when SAMD9 is knocked-out (Sivan et al., *MBio,* 2015). Both K1 and C7 have been found to interact with SAMD9 (Sivan et al., *MBio,* 2015). Overexpression of IRF1 leads to host restriction of C7L and K1L double deleted vaccinia virus (Meng et al., *Journal of Virology,* 2012). Both C7 and K1 interact with SAMD9 in vitro (Sivan et al., *MBio.* 2015). Whether C7 directly modulates IFN production or signaling is unknown. Type I IFN plays an important role in host defense of viral infection, and yet, the role of C7 in immune modulation of the IFN pathway is unclear.

Without wishing to be bound by theory, it is thought that vaccinia C7 is an inhibitor of type I IFN induction and IFN signaling. TANK Binding Kinase 1 (TBK1) is a serine/threonine kinase that plays a critical role in the induction of innate immune responses to various pathogen-associated molecular patterns (PAMPs), including nucleic acids. On the one hand, RIG-I-like receptors such as RIG-I and MDA5, which detect 5' triphosphate RNA and dsRNA, respectively, interact with a mitochondrial protein IPS-1 or MAVS, leading to the activation and phosphorylation of TBK1. Endosomal dsRNA binds to Toll-like receptor 3 (TLR3), which results in the recruitment of TRIF and TRAF3 and activation of TBK1. On the other hand, cytosolic DNA can be detected by the cytosolic DNA sensor cyclic GMP-AMP synthase (cGAS), which leads to the production of cyclic GMP-AMP (cGAMP). cGAMP, in turn, binds to the endoplasmic reticulum (ER)-localized adaptor STING, leading to the recruitment and activation of TBK1. TBK1 phosphorylates transcription factor IRF3, which translocates to the nucleus to activate IFNB gene expression. Without wishing to be bound by theory, it is believed that C7 inhibits IFNB induction by various stimuli, including RNA virus, DNA virus, poly (I:C), immunostimulatory DNA (ISD). C7 may exert its inhibitory effect at the level of TBK1/IRF3 complex. Once secreted, type I IFN binds to IFNAR, which leads to the activation of the JAK/STAT signaling pathway. Phosphorylated STAT1 and STAT2 translocate to the nucleus, where together with IRF9, they activate the expression of IFN-stimulated genes (ISGs). Without wishing to be bound by theory, it is believed that in addition to its ability to inhibit IFNB induction, C7 can also block IFNAR signaling through its interaction of STAT2, thereby preventing IFN-β-induced STAT2 phosphorylation. Without wishing to be bound by theory, it is believed that vaccinia C7 has dual inhibitory role of type I IFN production and signaling. Previous studies have shown that the deletion of C7L from WT vaccinia (VACVΔC7L) results in the attenuation of the virus and deletion of C7L from MVA (MVAΔC7L) leads to enhanced immunostimulatory functions compared with MVA.

Ectopic C7 expression has been shown to block STING, TBK1, or IRF3-induced IFNB and ISRE (interferon stimulated response element) promoter activation. Murine or human macrophage cell lines that overexpress C7 have been shown to have blunted innate immune responses to DNA or RNA stimuli, or the infection of DNA or RNA viruses. It has also been shown that overexpression of C7 attenuates ISG gene expression induced by IFN-β treatment. MVA with deletion of C7L (MVAΔC7L) infection of cDCs has been shown to induce higher levels of type I IFN than MVA. C7 has been shown to block IFN-β-induced Janus kinase/signal transducer and activator of transcription (JAK/STAT) signaling pathway via preventing Stat2 phosphorylation. C7 has been shown to directly interact with Stat2 as demonstrated by co-immunoprecipitation studies.

An illustrative full-length vaccinia virus C7 host range protein, given by GenBank Accession No. AAB96405.1 (SEQ ID NO: 6) is provided below.

```
  1 mgiqhefdii ingdialrnl qlhkgdnygc klkiisndyk klkfrfiirp dwseidevkg
 61 ltvfannyav kvnkvddtfy yviyeavihl ynkkteiliy sddenelfkh yypyislnmi
121 skkykvkeen ysspyiehpl ipyrdyesmd
```

Myxoma virus has three C7 orthologs, M62, M63, M64. Myxoma M64 shares similar structure features with vaccinia C7, despite having only 23% sequence identity. Myxoma M62 can rescue replication defects of VACVΔK1LΔC7L in human cells. Myxoma M63 deletion results in a recombinant virus that is non-replicative in rabbit cells. In some embodiments, the technology of the present disclosure provides an engineered myxoma virus such as MYXVΔM64R or MYXVΔM64R-hFlt3L-mOX40L.

VI. OX40 ligand (OX40L)

The OX40 ligand (OX40L) and its binding partner, tumor necrosis factor receptor OX40, are members of the TNFR/TNF superfamily and are expressed on activated CD4 and CD8 T-cells as well as a number of other lymphoid and non-lymphoid cells. The OX40L-OX40 interaction provides survival and activation signals for T-cells expressing OX40. OX40 additionally suppresses the differentiation and activity of Treg, further amplifying this process. OX40 and OX40L also regulate cytokine production from T-cells, antigen-presenting cells, NK cells, and NKT cells, and modulate cytokine receptor signaling. The OX40L of the MVAΔE3L-OX40L, MVAΔC7L-OX40L, MVAΔC7L-hFlt3L-OX40L, MVAΔE5R, VACVΔC7L-OX40L, VACVΔC7L-hFlt3L-OX40L, VACVΔE5R, and MYXVΔM31R recombinant viruses of the present technology can be either huOX40L or muOX40L.

Illustrative human OX40L (huOX40L) nucleic acid (SEQ ID NO: 7) and polypeptide sequences (SEQ ID NO: 8) are provided below.

```
huOX40L-ORF (SEQ ID NO: 7):
ATGGAAAGGG TCCAACCCCT GGAAGAGAAT GTGGGAAATG CAGCCAGGCC AAGATTCGAG

AGGAACAAGC TATTGCTGGT GGCCTCTGTA ATTCAGGGAC TGGGGCTGCT CCTGTGCTTC
```

-continued

ACCTACATCT GCCTGCACTT CTCTGCTCTT CAGGTATCAC ATCGGTATCC TCGAATTCAA

AGTATCAAAG TACAATTTAC CGAATATAAG AAGGAGAAAG GTTTCATCCT CACTTCCCAA

AAGGAGGATG AAATCATGAA GGTGCAGAAC AACTCAGTCA TCATCAACTG TGATGGGTTT

TATCTCATCT CCCTGAAGGG CTACTTCTCC CAGGAAGTCA ACATTAGCCT TCATTACCAG

AAGGATGAGG AGCCCCTCTT CCAACTGAAG AAGGTCAGGT CTGTCAACTC CTTGATGGTG

GCCTCTCTGA CTTACAAAGA CAAAGTCTAC TTGAATGTGA CCACTGACAA TACCTCCCTG

GATGACTTCC ATGTGAATGG CGGAGAACTG ATTCTTATCC ATCAAAATCC TGGTGAATTC

TGTGTCCTTT GA huOX40L polypeptide (SEQ ID NO: 8)

ME R V Q P L E E N V G N A A R P R F E R N K L L L V A S V I Q

G L G L L L C F T Y I C L H F S A L Q V S H R Y P R I Q S I K

V Q F T E Y K K E K G F I L T S Q K E D E I MK V Q N N S V I I

N C D G F Y L I S L K G Y F S Q E V N I S L H Y Q K D E E P L

F Q L K K V R S V N S L MV A S L T Y K D K V Y L N V T T D N T

S L D D F H V N G G E L I L I H Q N P G E F C V L Stop

Illustrative murine OX40L (muOX40L) nucleic acid (SEQ ID NO: 9) and polypeptide sequences (SEQ ID NO: 10) are provided below.

muOX40L-ORF (codon optimized)(SEQ ID NO: 9):
ATGGAGGGCGAGGGGGTCCAGCCTCTGGACGAGAACCTCGAAAACGGGTCTCGCCCTCGCTT

TAAATGGAAGAAGACTCTTAGGCTCGTTGTAAGCGGCATCAAGGGGGCCGGTATGTTGCTGT

GCTTCATATATGTGTGTTTGCAACTTAGCTCTTCACCTGCAAAAGACCCCCCCATACAACGC

CTTCGGGGGGCTGTGACCCGCTGTGAAGATGGTCAATTGTTTATTTCTTCTTACAAGAACGA

GTATCAGACGATGGAAGTCCAGAATAACTCCGTAGTGATTAAGTGTGACGGACTGTACATCA

TCTACTTGAAAGGATCTTTTTTCCAGGAGGTCAAAATTGACCTCCACTTCAGGGAGGATCAC

AACCCTATCTCAATCCCTATGTTGAACGACGGCAGAAGAATCGTCTTTACTGTAGTCGCTTC

ACTGGCCTTCAAGGATAAGGTGTACTTGACCGTAAACGCTCCTGATACCTTGTGCGAGCATT

TGCAAATCAACGATGGAGAACTTATCGTTGTCCAACTCACACCAGGTTACTGTGCTCCTGAG

GGCAGTTATCACAGTACAGTGAACCAAGTCCCACTGTGA muOX40L polypeptide (SEQ ID NO: 10):
ME G E G V Q P L D E N L E N G S R P R F K W K K T L R L V V S

G I K G A G ML L C F I Y V C L Q L S S S P A K D P P I Q R L R

G A V T R C E D G Q L F I S S Y K N E Y Q T ME V Q N N S V V I

K C D G L Y I I Y L K G S F F Q E V K I D L H F R E D H N P I

S I P ML N D G R R I V F T V V A S L A F K D K V Y L T V N A P

D T L C E H L Q I N D G E L I V V Q L T P G Y C A P E G S Y H

S T V N Q V P L Stop

The use of hFlt3L has been explored in various preclinical and clinical settings including stem cell mobilization in preparation for bone marrow transplantation, cancer immunotherapy such as expansion of dendritic cells, as well as a vaccine adjuvant. Recombinant human Flt3L (rhuFlt3L) has been tested in more than 500 human subjects and is bioactive, safe, and well-tolerated. Much progress has been made in understanding the critical role of the growth factor Flt3L

VII. Human Fms-like tyrosine kinase 3 ligand (hFlt3L)

Human Fms-like tyrosine kinase 3 ligand (hFlt3L), a type I transmembrane protein that stimulates the proliferation of bone marrow cells, was cloned in 1994 (Lyman et al., 1994).

in the development of DC subsets, including CD8α$^+$/CD103$^+$ DCs and pDCs.

CD103$^+$/CD8α$^+$ DCs are required for spontaneous cross-priming of tumor antigen-specific CD8$^+$ T-cells. It has been reported that CD103$^+$ DCs are sparsely present within the tumors and they compete for tumor antigens with abundant tumor-associated macrophages. CD103$^+$ DCs are uniquely capable of stimulating naïve as well as activated CD8$^+$ T-cells and are critical for the success of adoptive T-cell therapy (Broz, et al. *Cancer Cell,* 26(5):638-52 (2014)). Spranger et al. reported that the activation of oncogenic signaling pathway WNT/β-catenin leads to reduction of CD103$^+$ DCs and anti-tumor T-cells within the tumors (Spranger et al., 2015). Intratumoral delivery of Flt3L-cultured bone marrow derived dendritic cells (BMDCs) leads to responsiveness to the combination of anti-CTLA-4 and anti-PD-L1 immunotherapy (Spranger et al., 2015). Systemic administration of Flt3L, a growth factor for CD103$^+$ DCs, and intratumor injection of poly I:C (TLR3 agonist) expanded and activated the CD103$^+$ DC populations within the tumors and overcame resistance or enhanced responsiveness to immunotherapy in a murine melanoma and MC38 colon cancer models.

The recent discovery of tumor neoantigens in various solid tumors indicates that solid tumors harbor unique neoantigens that usually differ from person to person (Castle et al., *Cancer Res* 72:1081-1091 (2012); Schumacher et al., *Science* 348:69-74 (2015)). The genetically engineered or recombinant viruses disclosed herein do not exert their activity by expressing tumor antigens. Intratumoral delivery of the present genetically engineered or recombinant MVA viruses allows efficient cross-presentation of tumor neoantigens and generation of anti-tumor adaptive immunity within the tumors (and also extending systemically), and therefore leads to "in situ cancer vaccination" utilizing tumor differentiation antigens and neoantigens expressed by the tumor cells in mounting an immune response against the tumor.

Despite the presence of neoantigens generated by somatic mutations within tumors, the functions of tumor antigen-specific T-cells are often held in check by multiple inhibitory mechanisms (Mellman et al., *Nature* 480, 480-489 (2011)). For example, the up-regulation of cytotoxic T lymphocyte antigen 4 (CTLA-4) on activated T-cells can compete with T-cell co-stimulator CD28 to interact with CD80 (B71)/CD86 (B7.2) on dendritic cells (DCs), and thereby inhibit T-cell activation and proliferation. CTLA-4 is also expressed on regulatory T (Treg) cells and plays an important role in mediating the inhibitory function of Tregs (Wing et al., *Science* 322:271-275 (2008); Peggs, et al., *J. Exp. Med.* 206:1717-1725 (2009)). In addition, the expression of PD-L/PD-L2 on tumor cells can lead to the activation of the inhibitory receptor of the CD28 family, PD-1, leading to T-cell exhaustion. Immunotherapy utilizing antibodies against inhibitory receptors, such as CTLA-4 and programmed death 1 polypeptide (PD-1), have shown remarkable preclinical activities in animal studies and clinical responses in patients with metastatic cancers, and have been approved by the FDA for the treatment of metastatic melanoma, non-small cell lung cancer, as well as renal cell carcinoma (Leach et al., *Science* 271:1734-1746 (1996); Hodi et al., *NEJM* 363:711-723 (2010); Robert et al., *NEJM* 364:2517-2526 (2011); Topalian et al., *Cancer Cell* 27:450-461 (2012); Sharma et al., *Science* 348(6230):56-61 (2015)).

VIII. ΔE3L and E3LΔ83N

Poxviruses are extraordinarily adept at evading and antagonizing multiple innate immune signaling pathways by encoding proteins that interdict the extracellular and intracellular components of those pathways (Seet et al. *Annu. Rev. Immunol.* 21:377-423 (2003)). Chief among the poxvirus antagonists of intracellular innate immune signaling is the vaccinia virus duel Z-DNA and dsRNA-binding protein E3, which can inhibit the PKR and NF-κB pathways (Cheng et al., *Proc. Natl. Acad. Sci. USA* 89:4825-4829 (1992); Deng et al., *J. Virol.* 80:9977-9987 (2006)) that would otherwise be activated by vaccinia virus infection. A mutant vaccinia virus lacking the E3L gene (ΔE3L) has a restricted host range, is highly sensitive to IFN, and has greatly reduced virulence in animal models of lethal poxvirus infection (Beattie et al., *Virus Genes* 1289-94 (1996); Brandt et al., *Virology* 333263-270 (2004)). Recent studies have shown that infection of cultured cell lines with ΔE3L virus elicits proinflammatory responses that are masked during infection with wild-type vaccinia virus (Deng et al., *J. Virol.* 80:9977-9987 (2006); Langland et al. *J. Virol.* 80:10083-10095). Infection of a mouse epidermal dendritic cell line with wild-type vaccinia virus attenuated proinflammatory responses to the TLR agonists lipopolysaccharide (LPS) and poly (I:C), an effect that was diminished by deletion of E3L. Moreover, infection of the dendritic cells with ΔE3L virus triggered NF-κB activation in the absence of exogenous agonists (Deng et al., *J. Virol.* 80:9977-9987 (2006)). Whereas wild-type vaccinia virus infection of murine keratinocytes does not induce the production of proinflammatory cytokines and chemokines, infection with ΔE3L virus does induce the production of IFN-β, IL-6, CCL4 and CCL5 from murine keratinocytes, which is dependent on the cytosolic dsRNA-sensing pathway mediated by the mitochondrial antiviral signaling protein (MAVS; an adaptor for the cytosolic RNA sensors RIG-I and MDA5) and the transcription factor IRF3 (Deng et al., *J. Virol.* 82(21):10735-10746 (2008)).

E3LΔ83N virus with deletion of the Z-DNA-binding domain is 1,000-fold more attenuated than wild-type vaccinia virus in an intranasal infection model (Brandt et al., 2001). E3LΔ83N also has reduced neurovirulence compared with wild-type vaccinia in an intra-cranial inoculation model (Brandt et al., 2005). A mutation within the Z-DNA binding domain of E3 (Y48A) resulting in decreased Z-DNA-binding leads to decreased neurovirulence (Kim et al., 2003). Although the N-terminal Z-DNA binding domain of E3 is important in viral pathogenesis, how it affects host innate immune sensing of vaccinia virus is not well understood. Myxoma virus but not wild-type vaccinia infection of murine plasmacytoid dendritic cells induces type I IFN production via the TLR9/MyD88/IRF5/IRF7-dependent pathway (Dai et al., 2011). Myxoma virus E3 ortholog M029 retains the dsRNA-binding domain of E3 but lacks the Z-DNA binding domain of E3. It was found that the Z-DNA-binding domain of E3 (but probably not Z-DNA-binding activity per se) plays an important role in inhibiting poxviral sensing in murine and human pDCs (Dai et al., 2011; Cao et al., 2012).

Deletion of E3L sensitizes vaccinia virus replication to IFN inhibition in permissive RK13 cells and results in a host range phenotype, whereby ΔE3L cannot replicate in HeLa or BSC40 cells (Chang et al., 1995). The C-terminal dsRNA-binding domain of E3 is responsible for the host range effects, whereas E3LΔ83N virus with deletion of the N-terminal Z-DNA-binding domain is replication competent in HeLa and BSC40 cells (Brandt et al., 2001).

Vaccinia virus (Western Reserve strain; WR) with deletion of thymidine kinase is highly attenuated in non-dividing cells but is replicative in transformed cells (Buller et al., 1988). TK-deleted vaccinia virus selectively replicates in tumor cells in vivo (Puhlmann et al., 2000). Thorne et al. showed that compared with other vaccinia strains, WR strain has the highest burst ratio in tumor cell lines relative to normal cells (Thorne et al., 2007).

Figure 55A:
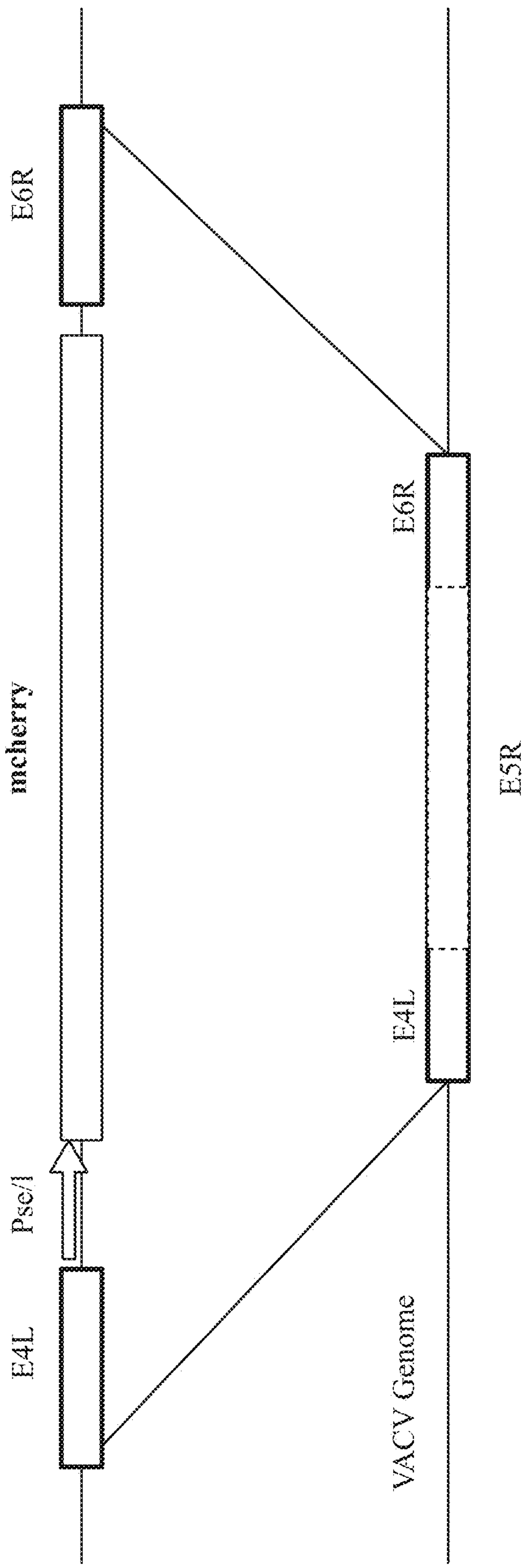
FIGS. 55A-55C show that VACVAE5R is highly attenuated in an intranasal infection model.
Figure 55B:
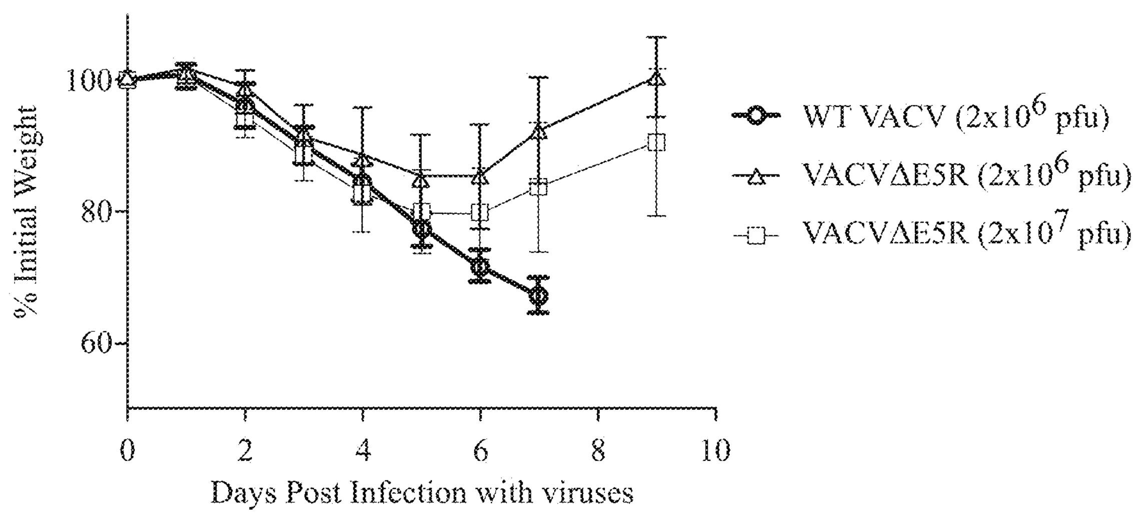
Figure 57C:
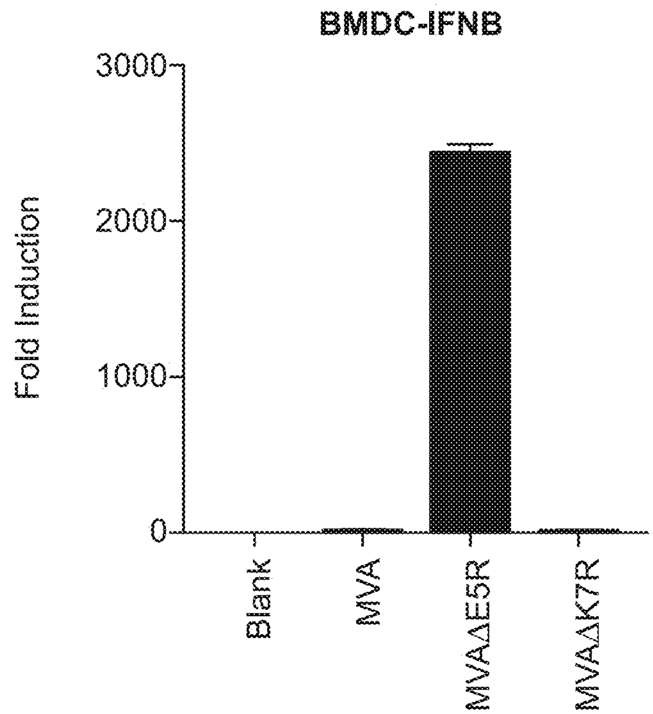
Figure 57D:
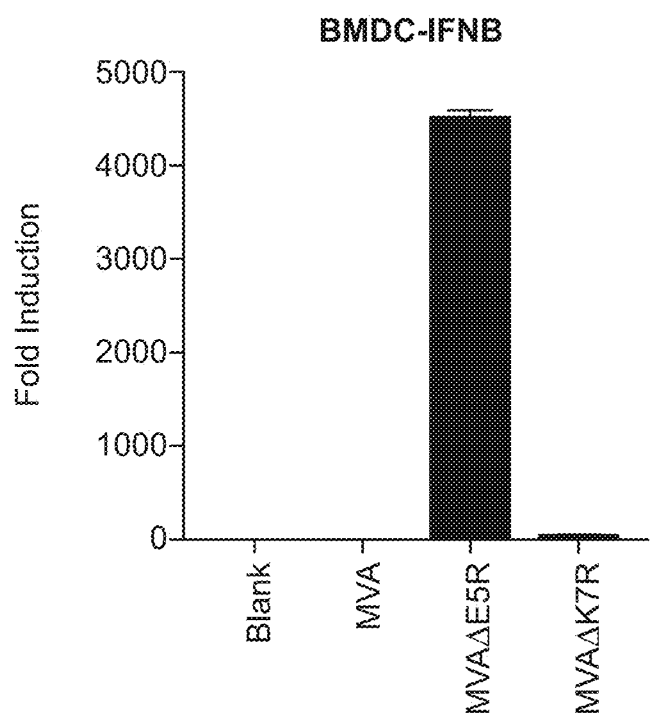
Figure 58A:
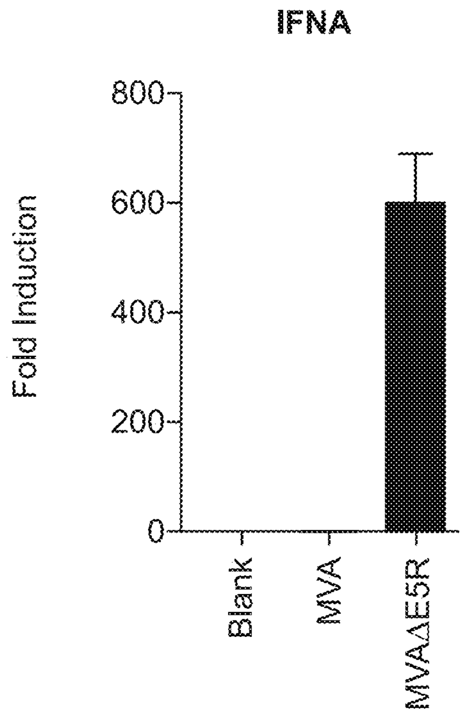
FIGS. 58A-58C show that BMDCs were infected with either MVA or MVAΔE5R at a MOI of 10. Cells were collected at 6 h post infection. IFNA (FIG. 58A), CCL4 (FIG. 58B), and CCL5 (FIG. 58C) gene expressions were determined by quantitative RT-PCR.
Figure 58B:
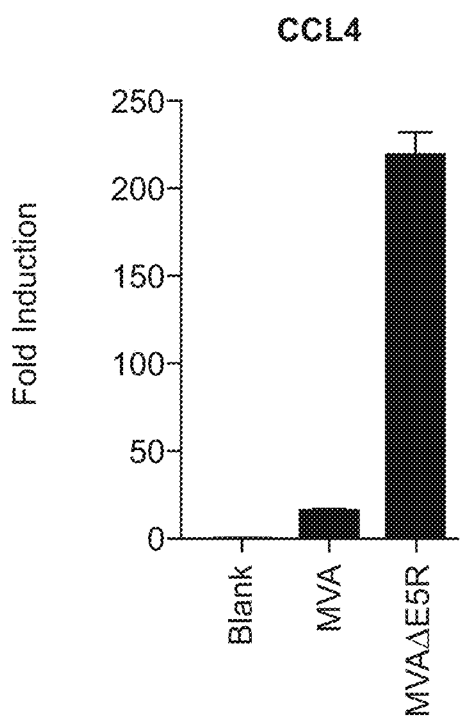
Figure 58C:
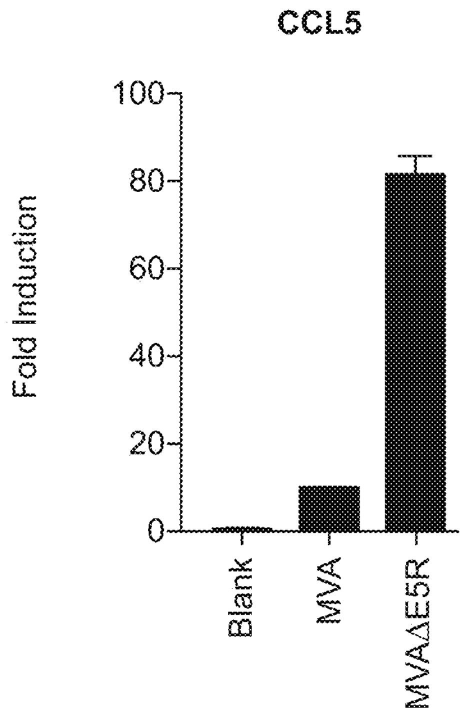
Figure 75A:
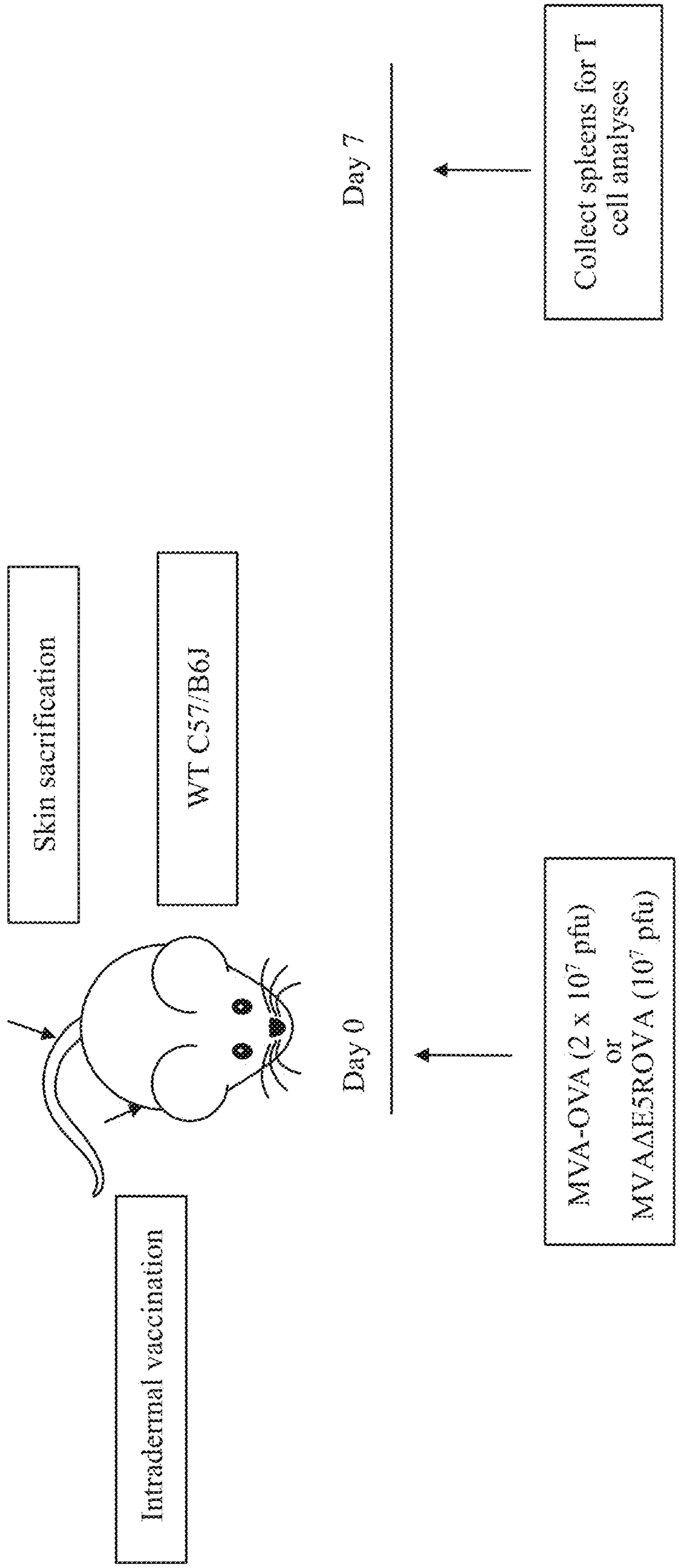
FIGS. 75A-75C show that deletion of the E5R gene from MVA improves vaccination efficacy.
Figure 75B:
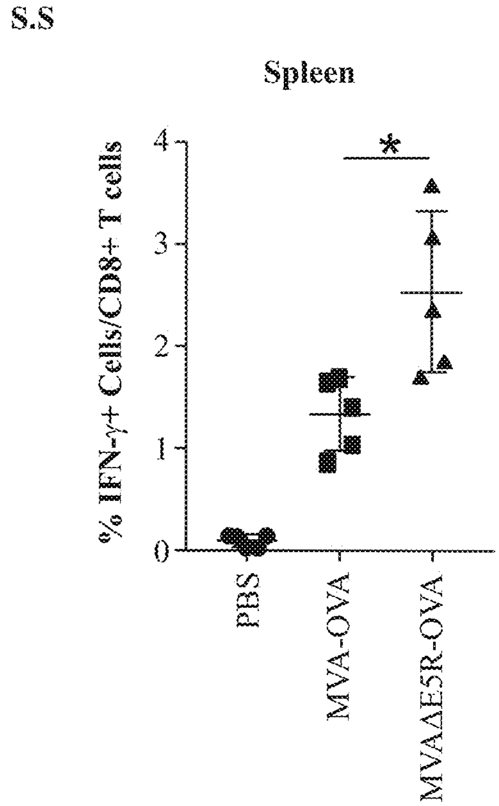
Figure 75C:
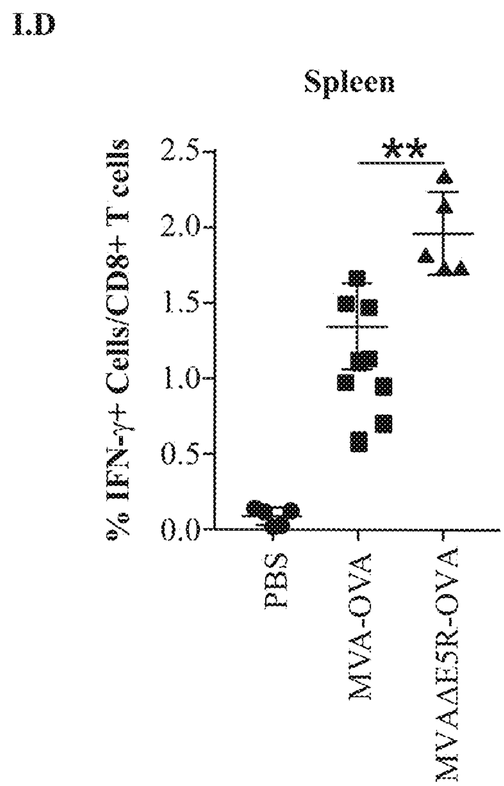
Figure 77A:
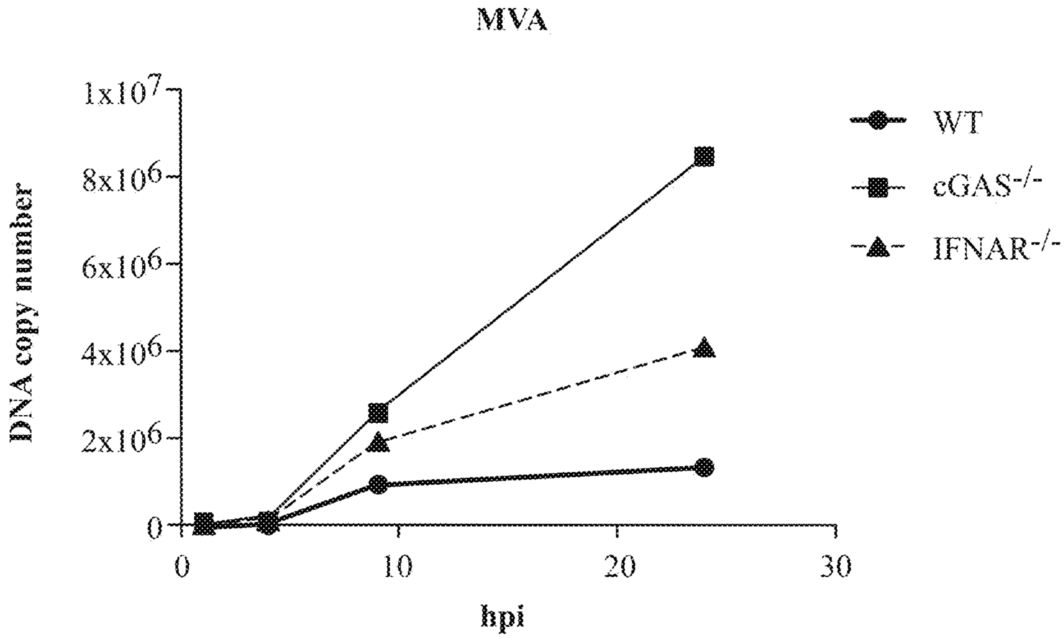
FIGS. 77A-77D show that MVAΔE5R gains its capacity to replicate its DNA in cGAS- or IFNAR1-deficient skin primary dermal fibroblasts. Skin primary dermal fibroblasts from WT, $cGAS^{-/-}$ or $IFNAR1^{-/-}$ mice were infected with either MVA or MVAΔE5R at a MOI of 3. Cells were collected 1, 4, 10 and 24 h post infection. Viral DNA copy numbers were determined by quantitative PCR.
Figure 77B:
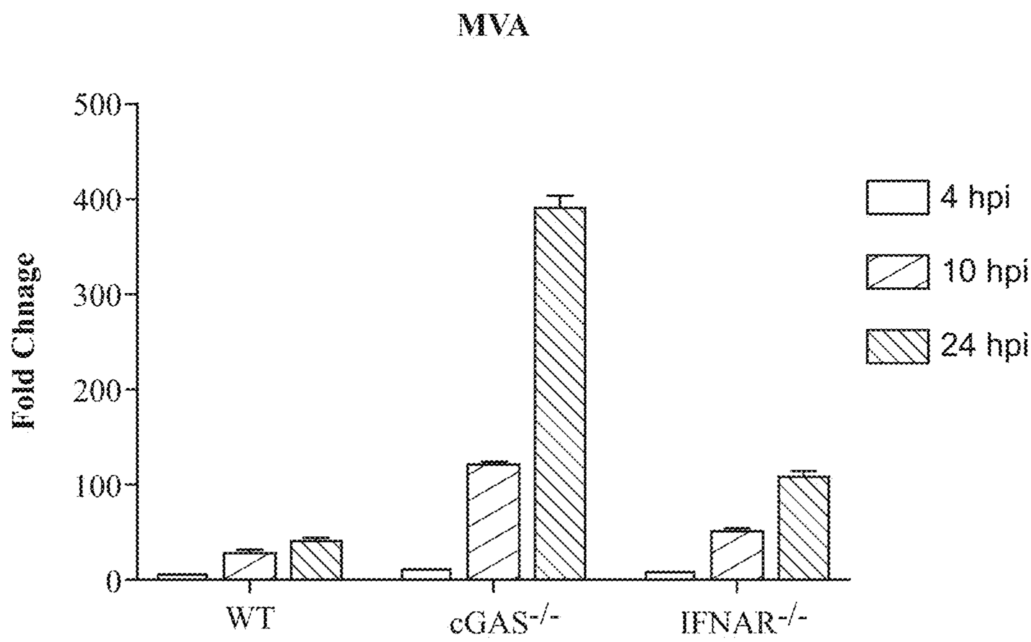
Figure 77C:
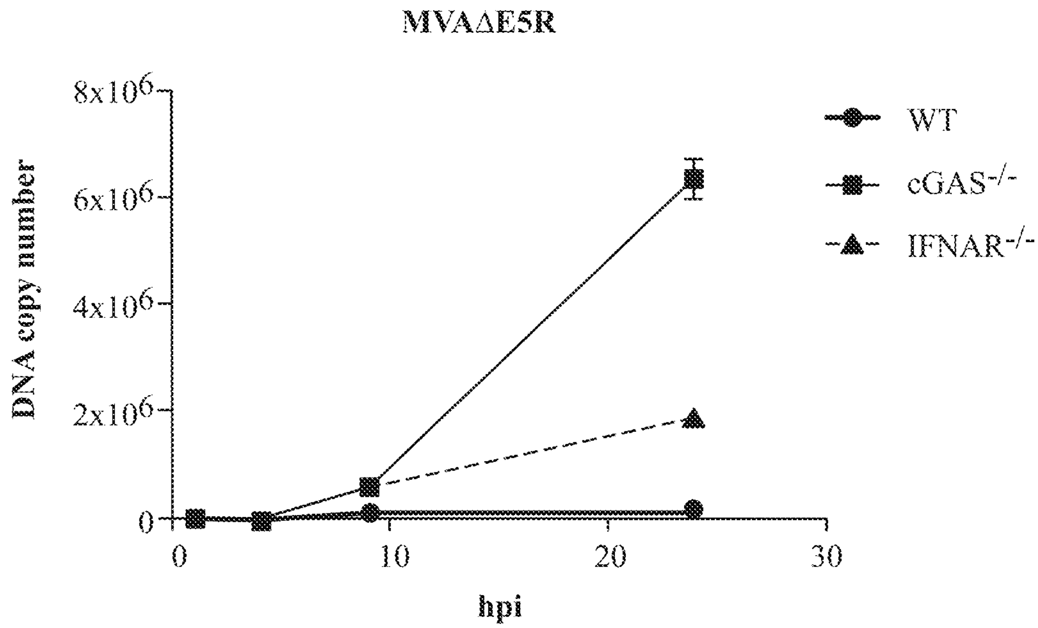
Figure 77D:
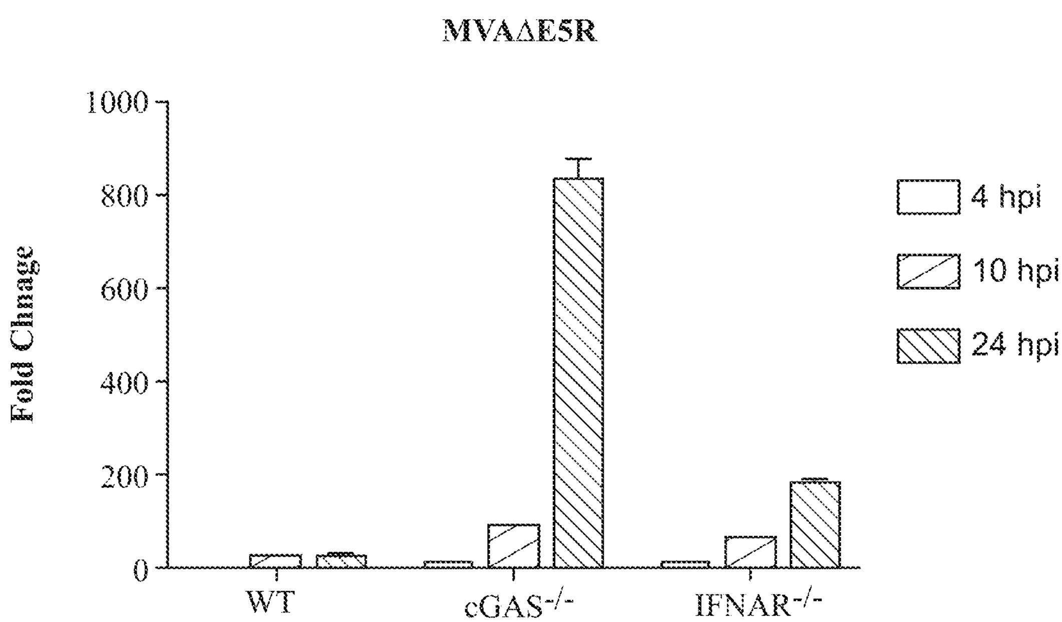
Figure 91A:
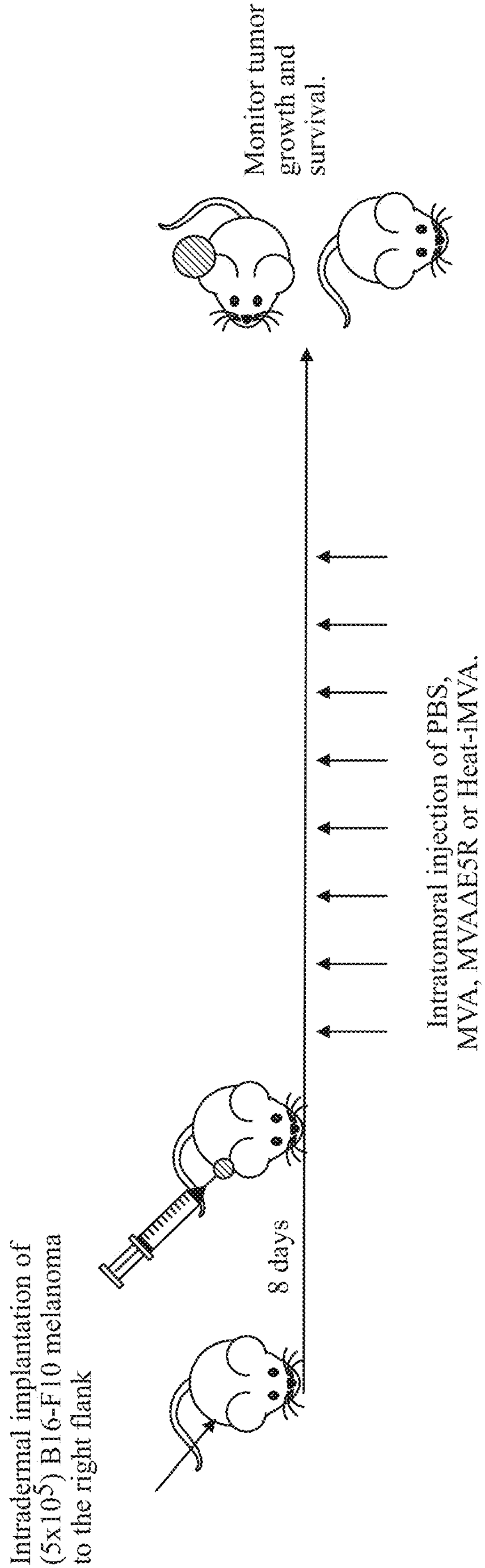
FIGS. 91A-91C are graphical representations of data showing IT MVAΔE5R delays tumor growth and prolongs survival in murine B16-F10 melanoma unilateral tumor implantation model.
Figures 91B, 91C:
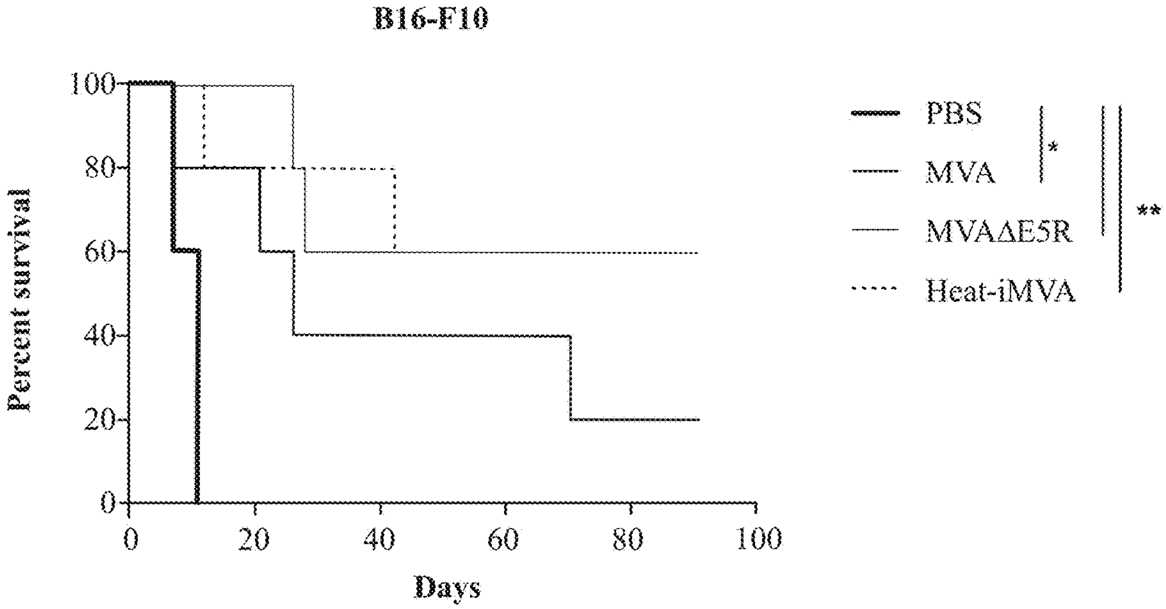

IX. Vaccinia virus E5 is a dominant inhibitor of the cytosolic DNA sensor cGAS The cytosolic DNA sensor cGAS plays an important role in detecting viral nucleic acid, which leads to type I IFN production. It has been shown that infection of conventional dendritic cells with modified vaccinia virus Ankara (MVA), a highly attenuated vaccinia strain, induces IFN production via a cGAS/STING-dependent mechanism. However, MVA infection triggers cGAS degradation. Vaccinia virus (VACV) is a cytoplasmic DNA virus, which encodes more than 200 genes. As described in the experimental examples section, seventy vaccinia viral early genes were screened for inhibition of cGAS/STING pathway in HEK293 T cells using a dual luciferase system. It was found that vaccinia E5R is a dominant inhibitor of the cGAS and is the key protein mediating cGAS degradation. MVAΔE5R induces much higher levels of type I IFN than MVA in multiple cell types, including bone marrow derived dendritic cells (BMDC), bone marrow-derived macrophages (BMDM), and skin primary fibroblasts (FIGS. 57C and 57D; 76A and 76B). MVAΔE5R-mediated type I IFN production is dependent on cGAS (FIGS. 58A-58C). Furthermore, MVAΔE5R gains replication capability in $cGAS^{-/-}$ skin fibroblasts (FIGS. 77C and 77D). As a vaccine vector, skin scarification or intradermal vaccination with MVAΔE5R-OVA leads to much higher OVA-specific $CD8^+$ T cell responses than MVA-OVA in vivo (FIGS. 75B and 75C). Intratumoral injection of MVAΔE5R leads to stronger anti-tumor immune responses and better survival compared with MVA (FIGS. 91A-91C). Finally, in an intranasal infection model, VACVΔE5R is at least 1000-fold attenuated compared with WT VACV (FIG. 55B). Taken together, these results provide strong evidence that E5 is a key viral virulence factor targeting the cytosolic DNA sensor cGAS and thereby inhibits type I IFN production. The inventors of the present technology are the first to describe the role of E5R in immune evasion.

An illustrative full-length vaccinia virus E5R host range protein, given by GenBank Accession No. AAB59825.1 (SEQ ID NO: 20) is provided below.

```
MLILTKVNIYMLIIVLWLYGYNFIISESQCPMINDDSFTLKRKYQIDSA
ESTIKMDKKRTKFQNRAKMVKEINQTIRAAQTHYETLKLGYIKFKRMIR
TTTLEDIAPSIPNNQKTYKLESDISAIGKASRNPSKMVYALLLYMFPNL
FGDDHRFIRYRMHPMSKIKHKIFSPFKLNLIRILVEERFYNNECRSNKW
RIIGTQVDKMLIAESDKYTIDARYNLKPMYRIKGKSEEDTLFIKQMVEQ
CVTSQELVEKVLKILFRDLFKSGEYKAYRYDDDVENGFIGLDTLKLNIV
HDIVEPCMPVRRPVAKILCKEMVNKYFENPLHIIGKNLQECIDEVSE
```

The myxoma ortholog of vaccinia virus E5R is M31R. An illustrative full-length myxoma virus M31R protein, given by GenBank Accession No. AAF14919.1 (SEQ ID NO: 21), is provided below.

```
MEGDYLIRPG EKQASYACRL LGILTKHSTY PPEEYEPLVR
SIMSMYNTLI KDDVIWFREI APYLYEYTMY KQNARNPSFY
```

-continued

```
ISTNVVNLTT CRVSKSSAKS AKYRAKSKQM KMRRVADGVP
FEEKLKRDEA IRQKNKKDYF EIKKLYMRLK KFVRGKKSAD
DNMLCNKVRM IYGHINEIER VAVNEYSMAK SLLHYVEPNL
FNDDKHHLFY RCTKMDGLGV LPSKKLNLIR VILENKEKIS
KRKWTMLKKY IDTVCATGKL RVRLGTYPYY KLKSLNALVA
SYQGDSVDEL KTLVLSSESL VDLTEKLIKT TFPEVVKSGE
GHNYRCYPDG THQGLDPERV IDMCYKARVA TDSESVVDVH
NAIVETVNRF LIRSEKKVGD NIDECIVMAK TIN
```

X. Engineered Poxvirus Strains of the Present Technology

MVAΔC7L

The disclosure of the present technology relates to a C7L mutant modified vaccinia Ankara (MVA) virus (i.e., MVAΔC7L; MVA virus comprising a C7L deletion; MVA genetically engineered to comprise a mutant C7L gene), or immunogenic compositions comprising the virus, in which the virus is engineered to express one or more specific genes of interest (SG), such as OX40L (MVAΔC7L-OX40L), and their use as a cancer immunotherapeutic. In some embodiments, the C7 gene of the MVA virus, through homologous recombination techniques, is engineered to contain a disruption comprising a heterologous nucleic acid sequence comprising one or more expression cassettes, which result in a C7 knockout such that the C7 gene is not expressed, expressed at levels so low as to have no effect, or the expressed protein is non-functional (e.g., is a null-mutation). In some embodiments, the ΔC7L mutant includes a heterologous nucleic acid sequence in place of all or a majority of the C7L gene sequence. For example, in some embodiments, the nucleic acid sequence corresponding to the position of C7 in the MVA genome (e.g., position 18,407 to 18,859 of SEQ ID NO: 1) is replaced with a heterologous nucleic acid sequence comprising an open reading frame that encodes a specific gene of interest (SG), such as human OX40L, resulting in MVAΔC7L-OX40L. In some embodiments, the expression cassette comprises a single open reading frame that encodes hFl3L, resulting in MVAΔC7L-hFl3L. (See, e.g., FIG. 5A).

Additionally or alternatively, in some embodiments, MVAΔC7L is engineered to express both OX40L and hFlt3L. In some embodiments, the thymidine kinase (TK) gene of the MVA virus (e.g., position 75,560 to 76,093 of SEQ ID NO: 1), through homologous recombination, is engineered to contain a disruption comprising a heterologous nucleic acid sequence comprising one or more expression cassettes, which results in a TK gene knockout such that the TK gene is not expressed, expressed at levels so low as to have no effect, or the expressed protein is non-functional (e.g., is a null-mutation). The resulting MVAΔCL-TK(−) virus is further engineered to comprise one or more expression cassettes that are flanked by a partial sequence of the TK gene (TK-L and TK-R) on either side (see, e.g., FIG. 5B). In some embodiments, the expression cassette comprises a single open reading frame that encodes a specific gene of interest (SG), such as OX40L or hFlt3L using the vaccinia viral synthetic early and late promoter (PsE/L), resulting in MVAΔC7L-TK(−)-OX40L. In some embodiments, the recombinant virus is further modified at the C7 locus, through homologous recombination techniques, to contain a disruption comprising a heterologous nucleic acid sequence comprising one or more expression cassettes, which result in a C7 knockout such that the C7 gene is not expressed, expressed at levels so low as to have no effect, or the expressed protein is non-functional (e.g., is a null-mutation). In some embodiments, the expression cassette comprises a single open reading frame that encodes a specific gene of interest (SG), such as hFlt3L, resulting in MVAΔC7L-hFlt3L-TK(−)-OX40L. In some embodiments, the expression cassette encoding OX40L is inserted into the C7 locus while the expression cassette encoding hFlt3L is inserted into the TK locus.

Additionally or alternatively, in some embodiments, the heterologous nucleic acid sequence comprises an expression cassette comprising two or more open reading frames encoding two or more specific genes of interest, separated by a nucleotide sequence that encodes, in the 5' to 3' direction, a protease cleavage site (e.g., a furin cleavage site) and a 2A peptide (Pep2A) sequence. For example, in some embodiments, MVAΔC7L encompasses a recombinant MVA virus in which all or a majority of the E5R gene sequence is replaced by a first specific gene of interest (e.g., hFtl3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as MVAΔC7LΔE5R-hFl3L-OX40L (see, e.g., FIG. 93A). As another example, in some embodiments, the present technology provides a recombinant MVAΔC7L-hFl3L-TK(−)-OX40LΔE5R virus that is formed by making three separate modifications. The first modification involves replacing the C7L C7Lgene, through homologous recombination at the C8L and C6R loci, with a heterologous nucleic acid sequence comprising an expression cassette comprising an open reading frame encoding hFl3L, thereby forming MVAΔC7L-hFl3L. For the second modification, through homologous recombination at the TK locus, the TK gene is replaced with a heterologous nucleic acid sequence comprising an expression cassette comprising an open reading frame encoding OX40L, thereby forming MVAΔC7L-hFl3L-TK(−)-OX40L. For the third modification, through homologous recombination at the E4L and E6R loci, the E5R gene is replaced with a heterologous nucleic acid sequence comprising an expression cassette comprising an open reading frame encoding a selectable marker, such as mCherry, thereby forming MVAAC7L-hFl3L-TK(−)-OX40LΔE5R (see, e.g., FIG. 92A).

In some embodiments, the recombinant MVAΔC7L-OX40L viruses described above are modified to express at least one additional heterologous gene, such as any one or more of hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include any one or more of the following deletions: E3L (ΔE3L); E3LΔ83N; B2R (ΔB2R), B19R (B18R; ΔWR200); E5R; K7R; C12L (IL18BP); B8R; B14R; N1L; C11R; K1L; M1L, N2L, and/or WR199.

Although in certain embodiments described above, the transgene may be inserted into the TK locus, splitting the TK gene and obliterating it, other suitable integration loci can be selected. For example, MVA encodes several immune modulatory genes, including but not limited to C11, K3, F1, F2, F4, F6, F8, F9, F11, F14.5, J2, A46, E3L, B18R (WR200), E5R, K7R, C12L, B8R, B14R, N1L, C11R, K1L, C16, M1L, N2L, and WR199. Accordingly, in some embodiments, these genes can be deleted to potentially enhance immune activating properties of the virus and allow insertion of transgenes. For example, in some embodiments, the present technology provides an MVAΔC7L-hFlt3L-TK(−)-OX40L virus expressing transgenes IL-2, IL-12, IL-18, IL-15, and/or IL-21 from within the E5R gene locus. In other embodiments, no further heterologous genes are added other than those provided in the name of the virus herein (e.g. OX40L or OX40L and hFlt3L), and/or no further viral genes other than C7L or C7L and TK are disrupted or deleted.

Figure 5A:
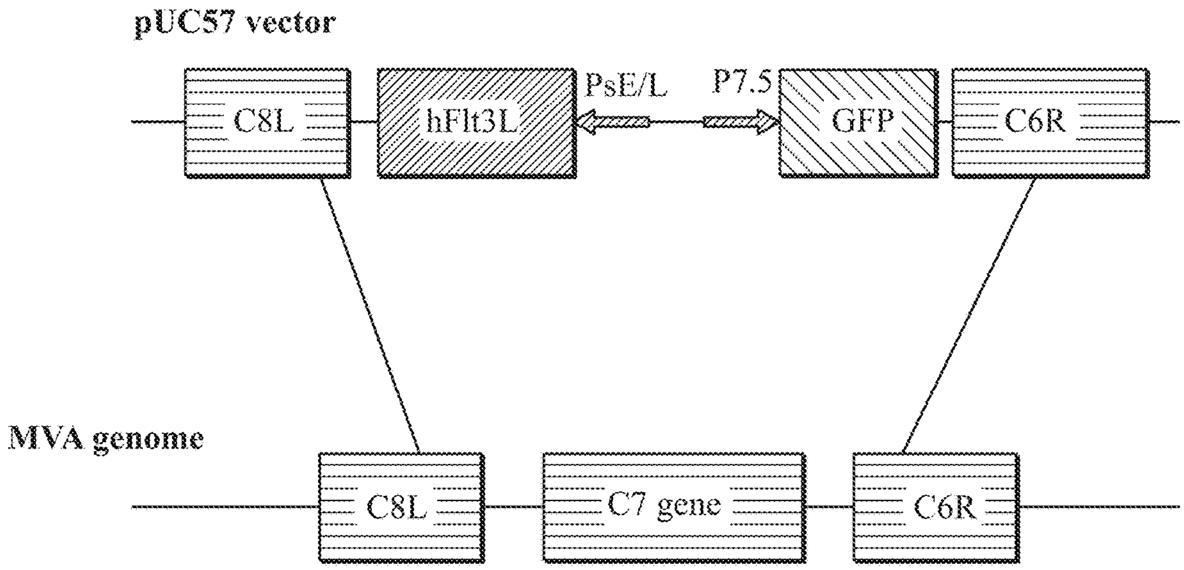
FIGS. 5A and 5B show a schematic diagram of two-step homologous recombination to generate MVAΔC7L-hFlt3L-TK(−)-muOX40L.
Figure 5B:
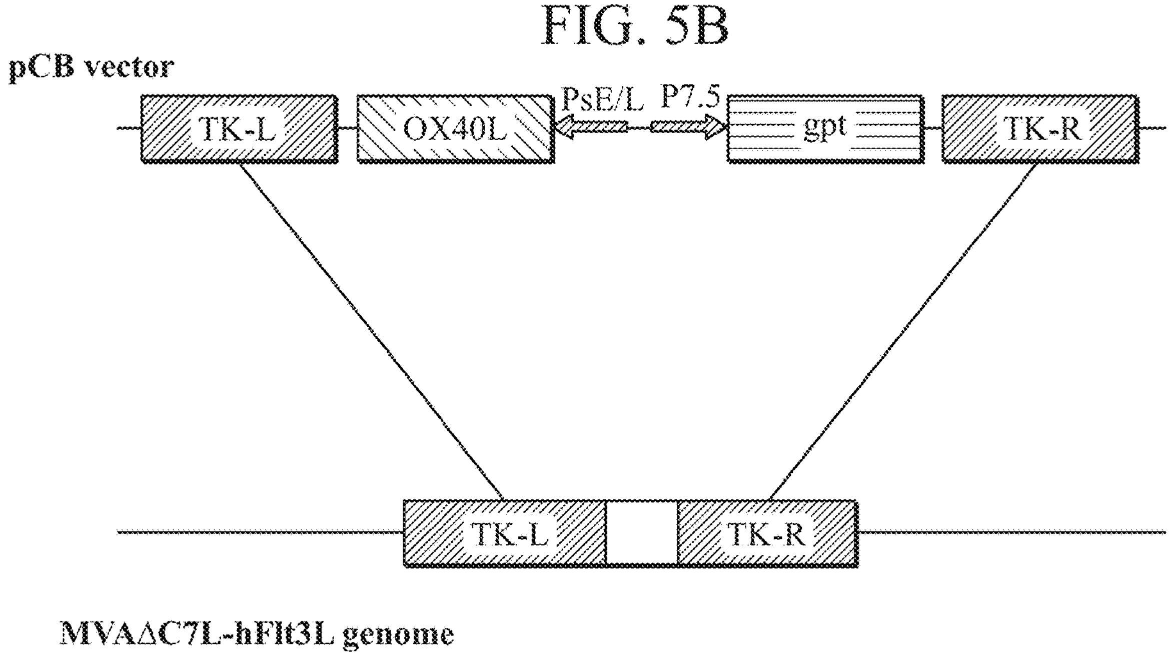

In some embodiments, the heterologous nucleotide sequence further comprises an additional expression cassette comprising an open reading frame that encodes a selectable marker operably linked to a promoter that is capable of directing expression of the selectable marker (FIGS. 5A-5B). In some embodiments, the selectable marker is a xanthine-guanine phosphoribosyl transferase (gpt) gene. In some embodiments, the selectable marker is a green fluorescent protein (GFP) gene. In some embodiments, the selectable marker is an mCherry gene encoding a red fluorescent protein.

Non-limiting examples of OX40L expression construct open reading frames according to the present technology are shown in SEQ ID NOs: 3 and 5 (Table 1). A non-limiting example of an hFlt3L expression construct according to the present technology is shown in SEQ ID NO: 4 (Table 1).

TABLE 1

| Exemplary nucleotide sequences for the open reading frames of the recombinant MVA constructs of the present technology. |
|---|
| pCB-mOX40L-gpt vector nucleic acid sequence (SEQ ID NO: 3) |
| CGCGCGTAATACGACTCACTATAGGGCGAATTGGAGCTCTTTTTATCTGCGCGGTTAAC |
| CGCCTTTTTATCCATCAGGTGATCTGTTTTTATTGTGGAGTCTAGATTATCACAGTGGG |
| ACTTGGTTCACTGTACTGTGATAACTGCCCTCAGGAGCACAGTAACCTGGTGTGAGTTG |
| GACAACGATAAGTTCTCCATCGTTGATTTGCAAATGCTCGCACAAGGTATCAGGAGCG |
| TTTACGGTCAAGTACACCTTATCCTTGAAGGCCAGTGAAGCGACTACAGTAAAGACGA |
| TTCTTCTGCCGTCGTTCAACATAGGGATTGAGATAGGGTTGTGATCCTCCCTGAAGTGG |
| AGGTCAATTTTGACCTCCTGGAAAAAAGATCCTTTCAAGTAGATGATGTACAGTCCGT |
| CACACTTAATCACTACGGAGTTATTCTGGACTTCCATCGTCTGATACTCGTTCTTGTAA |

TABLE 1-continued

Exemplary nucleotide sequences for the open reading frames of the recombinant MVA constructs of the present technology.

GAAGAAATAAACAATTGACCATCTTCACAGCGGGTCACAGCCCCCCGAAGGCGTTGTA

TGGGGGGGTCTTTTGCAGGTGAAGAGCTAAGTTGCAAACACACATATATGAAGCACAG

CAACATACCGGCCCCCTTGATGCCGCTTACAACGAGCCTAAGAGTCTTCTTCCATTTAA

AGCGAGGGCGAGACCCGTTTTCGAGGTTCTCGTCCAGAGGCTGGACCCCCTCGCCCTC

CATGGTGGTGGCCTAGAATTCGATATCAAGCTCAGGCCTAGATCTGTCGACTTCGAGC

TTATTTATATTCCAAAAAAAAAAAATAAAATTTCAATTTTTAAGCTTTCACTAATTCCA

AACCCACCCGCTTTTTATAGTAAGTTTTTCACCCATAAATAATAAATACAATAATTAAT

TTCTCGTAAAAGTAGAAAATATATTCTAATTTATTGCACGGTAAGGAAGTAGATCATA

ACTCGAGGAATTGGGGATCTCTATAATCTCGCGCAACCTATTTTCCCCTCGAACACTTT

TTAAGCCGTAGATAAACAGGCTGGGACACTTCACATGAGCGAAAAATACATCGTCACC

TGGGACATGTTGCAGATCCATGCACGTAAACTCGCAAGCCGACTGATGCCTTCTGAAC

AATGGAAAGGCATTATTGCCGTAAGCCGTGGCGGTCTGGTACCGGGTGCGTTACTGGC

GCGTGAACTGGGTATTCGTCATGTCGATACCGTTTGTATTTCCAGCTACGATCACGACA

ACCAGCGCGAGCTTAAAGTGCTGAAACGCGCAGAAGGCGATGGCGAAGGCTTCATCG

TTATTGATGACCTGGTGGATACCGGTGGTACTGCGGTTGCGATTCGTGAAATGTATCCA

AAAGCGCACTTTGTCACCATCTTCGCAAAACCGGCTGGTCGTCCGCTGGTTGATGACTA

TGTTGTTGATATCCCGCAAGATACCTGGATTGAACAGCCGTGGGATATGGGCGTCGTA

TTCGTCCCGCCAATCTCCGGTCGCTAATCTTTTCAACGCCTGGCACTGCCGGGCGTTGT

TCTTTTTAACTTCAGGCGGGTTACAATAGTTTCCAGTAAGTATTCTGGAGGCTGCATCC

ATGACACAGGCAAACCTGCGGATCCCAGCTTTTGTTCCCTTTAGTGAGGGTTAATTGCG

CGCAGTTATAGTAGCCGCACTCGATGGGACATTTCAACGTAAACCGTTTAATAATATTT

TGAATCTTATTCCATTATCTGAAATGGTGGTAAAACTAACTGCTGTGTGTATGAAATGC

TTTAAGGAGGCTTCCTTTTCTAAACGATTGGGTGAGGAAACCGAGATAGAAATAATAG

GAGGTAATGATATGTATCAATCGGTGTGTAGAAAGTGTTACATCGACTCATAATATTA

TATTTTTTATCTAAAAAACTAAAAATAAACATTGATTAAATTTTAATATAATACTTAAA

AATGGATGTTGTGTCGTTAGATAAACCGTTTATGTATTTTGAGGAAATTGATAATGAGT

TAGATTACGAACCAGAAAGTGCAAATGAGGTCGCAAAAAAACTGCCGTATCAAGGAC

AGTTAAAACTATTACTAGGAGAATTATTTTTTCTTAGTAAGTTACAGCGACACGGTATA

TTAGATGGTGCCACCGTAGTGTATATAGGATCTGCTCCCGGTACACATATACGTTATTT

GAGAGATCATTTCTATAATTTAGGAGTGATCATCAAATGGATGCTAATTGACGGCCGC

CATCATGATCCTATTTTAAATGGATTGCGTGATGTGACTCTAGTGACTCGGTTCGTTGA

TGAGGAATATCTACGATCCATCAAAAAACAACTGCATCCTTCTAAGATTATTTTAATTT

CTGATGTGAGATCCAAACGAGGAGGAAATGAACCTAGTACGGCGGATTTACTAAGTA

ATTACGCTCTACAAAATGTCATGATTAGTATTTTAAACCCCGTGGCGTCTAGTCTTAAA

TGGAGATGCCCGTTTCCAGATCAATGGATCAAGGACTTTTATATCCCACACGGTAATA

AAATGTTACAACCTTTTGCTCCTTCATATTCAGCTGAAATGAGATTATTAAGTATTTAT

ACCGGTGAGAACATGAGACTGACTCGGGCCGCGTTGCTGGCGTTTTTCCATAGGCTCC

GCCCCCCTGACGAGCATCACAAAAATCGACGCTCAAGTCAGAGGTGGCGAAACCCGA

TABLE 1-continued

| Exemplary nucleotide sequences for the open reading frames of the recombinant MVA constructs of the present technology. |
|---|
| CAGGACTATAAAGATACCAGGCGTTTCCCCCTGGAAGCTCCCTCGTGCGCTCTCCTGTT |
| CCGACCCTGCCGCTTACCGGATACCTGTCCGCCTTTCTCCCTTCGGGAAGCGTGGCGCT |
| TTCTCAATGCTCACGCTGTAGGTATCTCAGTTCGGTGTAGGTCGTTCGCTCCAAGCTGG |
| GCTGTGTGCACGAACCCCCCGTTCAGCCCGACCGCTGCGCCTTATCCGGTAACTATCGT |
| CTTGAGTCCAACCCGGTAAGACACGACTTATCGCCACTGGCAGCAGCCACTGGTAACA |
| GGATTAGCAGAGCGAGGTATGTAGGCGGTGCTACAGAGTTCTTGAAGTGGTGGCCTAA |
| CTACGGCTACACTAGAAGGACAGTATTTGGTATCTGCGCTCTGCTGAAGCCAGTTACCT |
| TCGGAAAAAGAGTTGGTAGCTCTTGATCCGGCAAACAAACCACCGCTGGTAGCGGTGG |
| TTTTTTTGTTTGCAAGCAGCAGATTACGCGCAGAAAAAAAGGATCTCAAGAAGATCCT |
| TTGATCTTTTCTACGGGGTCTGACGCTCAGTGGAACGAAAACTCACGTTAAGGGATTTT |
| GGTCATGAGATTATCAAAAAGGATCTTCACCTAGATCCTTTTAAATTAAAAATGAAGT |
| TTTAAATCAATCTAAAGTATATATGAGTAAACTTGGTCTGACAGTTACCAATGCTTAAT |
| CAGTGAGGCACCTATCTCAGCGATCTGTCTATTTCGTTCATCCATAGTTGCCTGACTCC |
| CCGTCGTGTAGATAACTACGATACGGGAGGGCTTACCATCTGGCCCCAGTGCTGCAAT |
| GATACCGCGAGACCCACGCTCACCGGCTCCAGATTTATCAGCAATAAACCAGCCAGCC |
| GGAAGGGCCGAGCGCAGAAGTGGTCCTGCAACTTTATCCGCCTCCATCCAGTCTATTA |
| ATTGTTGCCGGGAAGCTAGAGTAAGTAGTTCGCCAGTTAATAGTTTGCGCAACGTTGTT |
| GCCATTGCTGCAGGCATCGTGGTGTCACGCTCGTCGTTTGGTATGGCTTCATTCAGCTC |
| CGGTTCCCAACGATCAAGGCGAGTTACATGATCCCCCATGTTGTGCAAAAAAGCGGTT |
| AGCTCCTTCGGTCCTCCGATCGTTGTCAGAAGTAAGTTGGCCGCAGTGTTATCACTCAT |
| GGTTATGGCAGCACTGCATAATTCTCTTACTGTCATGCCATCCGTAAGATGCTTTTCTG |
| TGACTGGTGAGTACTCAACCAAGTCATTCTGAGAATAGTGTATGCGGCGACCGAGTTG |
| CTCTTGCCCGGCGTCAACACGGGATAATACCGCGCCACATAGCAGAACTTTAAAAGTG |
| CTCATCATTGGAAAACGTTCTTCGGGGCGAAAACTCTCAAGGATCTTACCGCTGTTGA |
| GATCCAGTTCGATGTAACCCACTCGTGCACCCAACTGATCTTCAGCATCTTTTACTTTC |
| ACCAGCGTTTCTGGGTGAGCAAAAACAGGAAGGCAAAATGCCGCAAAAAAGGGAATA |
| AGGGCGACACGGAAATGTTGAATACTCATACTCTTCCTTTTTCAATATTATTGAAGCAT |
| TTATCAGGGTTATTGTCTCATGAGCGGATACATATTTGAATGTATTTAGAAAAATAAAC |
| AAATAGGGGTTCCGCGCACATTTCCCCGAAAAGTGCCACCTGACGTCTAAGAAACCAT |
| TATTATCATGACATTAACCTATAAAAATAGGCGTATCACGAGGCCCTTTCGTCTTCGAA |
| TAAATACCTGTGACGGAAGATCACTTCGCAGAATAAATAAATCCTGGTGTCCCTGTTG |
| ATACCGGGAAGCCCTGGGCCAACTTTTGGCGAAAATGAGACGTTGATCGGCACGTAAG |
| AGGTTCCAACTTTCACCATAATGAAATAAGATCACTACCGGGCGTATTTTTTGAGTTAT |
| CGAGATTTTCAGGAGCTAAGGAAGCTAAAATGGAGAAAAAAATCACTGGATATACCA |
| CCGTTGATATATCCCAATGGCATCGTAAAGAACATTTTGAGGCATTTCAGTCAGTTGCT |
| CAATGTACCTATAACCAGACCGTTCAGAGCTTTTGGGATCAATAAATGGATCACAACC |
| AGTATCTCTTAACGATGTTCTTCGCAGATGATGATTCATTTTTTAAGTATTTGGCTAGTC |
| AAGATGATGAATCTTCATTATCTGATATATTGCAAATCACTCAATATGTAGCTAGACTT |
| TCTGTTATTATTATTGATCCAATCAAAAAATAAATTAGAAGCCGTGGGTCATTGTTATG |

TABLE 1-continued

Exemplary nucleotide sequences for the open reading frames of the recombinant MVA constructs of the present technology.

AATCTCTTTCAGAGGAATACAGACAATTGACAAAATTCACAGACTTTCAAGATTTTAA

AAAACTGTTTAACAAGGTCCCTATTGACAGATGGAAGGGTCAAACTTAATAAAGGATA

TTTGTTCGACTTTGTGATTAGTTTGATGCGATTCAAAAAAGAATCCTCTCTAGCTACCA

CCGCAATAGATCCTGTTAGATACATAGATCCTCGTCGCAATATCGCATTTTCTAACGTG

ATGGATATATTAAAGTCGAATAAAGTGAACAATAATTAATTCTTTATTGTCATCATGAA

CGGCGGACATATTCAGTTGATAATCGGCCCCATGTTTTCAGGTAAAAGTACAGAATTA

ATTAGACGAGTTAGACGTTATCAAATAGCTCAATATAAATGCGTGACTATAAAATATT

CTAACGATAATAGATACGGAACGGGACTATGGACGCATGATAAGAATAATTTTGAAGC

ATTGGAAGCAACTAAACTATGTGATCTCTTGGAATCAATTACAGATTTCTCCGTGATAG

G pUC57-delC7-hOX40L-mCherry vector nucleic acid sequence
(SEQ ID NO: 5)

1 TCGCGCGTTT CGGTGATGAC GGTGAAAACC TCTGACACAT GCAGCTCCCG GAGACGGTCA

61 CAGCTTGTCT GTAAGCGGAT GCCGGGAGCA GACAAGCCCG TCAGGGCGCG TCAGCGGGTG

121 TTGGCGGGTG TCGGGGCTGG CTTAACTATG CGGCATCAGA GCAGATTGTA CTGAGAGTGC

181 ACCATATGCG GTGTGAAATA CCGCACAGAT GCGTAAGGAG AAAATACCGC ATCAGGCGCC

241 ATTCGCCATT CAGGCTGCGC AACTGTTGGG AAGGGCGATC GGTGCGGGCC TCTTCGCTAT

301 TACGCCAGCT GGCGAAAGGG GGATGTGCTG CAAGGCGATT AAGTTGGGTA ACGCCAGGGT

361 TTTCCCAGTC ACGACGTTGT AAAACGACGG CCAGTGAATT CGAGCTCGGT ACCTCGCGAA

421 TGCATCTAGA TTCGCAGATG ATGATTCATT TTTTAAGTAT TTGGCTAGTC AAGATGATGA

481 ATCTTCATTA TCTGATATAT TGCAAATCAC TCAATATCTA GACTTTCTGT TATTATTATT

541 GATCCAATCA AAAAATAAAT TAGAAGCCGT GGGTCATTGT TATGAATCTC TTTCAGAGGA

601 ATACAGACAA TTGACAAAAT TCACAGACTT TCAAGATTTT AAAAAACTGT TTAACAAGGT

661 CCCTATTGTT ACAGATGGAA GGGTCAAACT TAATAAAGGA TATTTGTTCG ACTTTGTGAT

721 TAGTTTGATG CGATTCAAAA AAGAATCCTC TCTAGCTACC ACCGCAATAG ATCCTATTAG

781 ATACATAGAT CCTCGTCGCG ATATCGCATT TTCTAACGTG ATGGATATAT TAAAGTCGAA

841 TAAAGTGAAC AATAATTAAT TCTTTATTGT CATCAGGCCT AGAAAAAGCT AGTTCACTAA

901 TTCCAAACCC ACCCGCTTTT TATAGTAAGT TTTTCACCCA TAAATAATAA ATACAATAAT

961 TAATTTCTCG TAAAAGTAGA AAATATATTC TAATTTATTG CACGGTAAGG AAGTAGATCA

1021 TAACTCGACA TGGTGAGCAA GGGCGAGGAG GATAACATGG CCATCATCAA GGAGTTCATG

1081 CGCTTCAAGG TGCACATGGA GGGCTCCGTG AACGGCCACG AGTTCGAGAT CGAGGGCGAG

1141 GGCGAGGGCC GCCCCTACGA GGGCACCCAG ACCGCCAAGC TGAAGGTGAC CAAGGGTGGC

1201 CCCCTGCCCT TCGCCTGGGA CATCCTGTCC CCTCAGTTCA TGTACGGCTC CAAGGCCTAC

1261 GTGAAGCACC CCGCCGACAT CCCCGACTAC TTGAAGCTGT CCTTCCCCGA GGGCTTCAAG

1321 TGGGAGCGCG TGATGAACTT CGAGGACGGC GGCGTGGTGA CCGTGACCCA GGACTCCTCC

1381 CTGCAGGACG GCGAGTTCAT CTACAAGGTG AAGCTGCGCG GCACCAACTT CCCCTCCGAC

1441 GGCCCCGTAA TGCAGAAGAA GACCATGGGC TGGGAGGCCT CCTCCGAGCG GATGTACCCC

1501 GAGGACGGCG CCCTGAAGGG CGAGATCAAG CAGAGGCTGA AGCTGAAGGA CGGCGGCCAC

1561 TACGACGCTG AGGTCAAGAC CACCTACAAG GCCAAGAAGC CCGTGCAGCT GCCCGGCGCC

TABLE 1-continued

| Exemplary nucleotide sequences for the open reading frames of the recombinant MVA constructs of the present technology. |
|---|
| 1621 TACAACGTCA ACATCAAGTT GGACATCACC TCCCACAACG AGGACTACAC CATCGTGGAA |
| 1681 CAGTACGAAC GCGCCGAGGG CCGCCACTCC ACCGGCGGCA TGGACGAGCT GATCACGAAT |
| 1741 TCTAGCTCAA AGGACACAGA ATTCACCAGG ATTTTGATGG ATAAGAATCA GTTCTCCGCC |
| 1801 ATTCACATGG AAGTCATCCA GGGAGGTATT GTCAGTGGTC ACATTCAAGT AGACTTTGTC |
| 1861 TTTGTAAGTC AGAGAGGCCA CCATCAAGGA GTTGACAGAC CTGACCTTCT TCAGTTGGAA |
| 1921 GAGGGGCTCC TCATCCTTCT GGTAATGAAG GCTAATGTTG ACTTCCTGGG AGAAGTAGCC |
| 1981 CTTCAGGGAG ATGAGATAAA ACCCATCACA GTTGATGATG ACTGAGTTGT TCTGCACCTT |
| 2041 CATGATTTCA TCCTCCTTTT GGGAAGTGAG GATGAAACCT TTCTCCTTCT TATATTCGGT |
| 2101 AAATTGTACT TTGATACTTT GAATTCGAGG ATACCGATGT GATACCTGAA GAGCAGAGAA |
| 2161 GTGCAGGCAG ATGTAGGTGA AGCACAGGAG CAGCCCCAGT CCCTGAATTA CAGAGGCCAC |
| 2221 CAGCAATAGC TTGTTCCTCT CGAATCTTGG CCTGGCTGCA TTTCCCACAT TCTCTTCCAG |
| 2281 GGGTTGGACC CTTTCCATGA ATTCGTCGAC TTCGAGCTTA TTTATATTCC AAAAAAAAAA |
| 2341 AATAAAATTT CAATTTTTAA GCTTTATTAT ATTTTTTATC TAAAAAACTA AAAATAAACA |
| 2401 TTGATTAAAT TTTAATATAA TACTTAAAAA TGGATGTTGT GTCGTTAGAT AAACCGTTTA |
| 2461 TGTATTTTGA GGAAATTGAT AATGAGTTAG ATTACGAACC AGAAAGTGCA AATGAGGTCG |
| 2521 CAAAAAAACT GCCGTATCAA GGACAGTTAA AACTATTACT AGGAGAATTA TTTTTTCTTA |
| 2581 GTAAGTTACA GCGACACGGT ATATTAGATG GTGCCACCGT AGTGTATATA GGATCTGCTC |
| 2641 CCGGTACACA TATACGTTAT TTGAGAGATC ATTTCTATAA TTTAGGAGTG ATCATCAAAT |
| 2701 GGATGCTAAT TGACGGCCGC CATCATGATC CTATTTTAAA TGGATTGCGT GATGTGACTC |
| 2761 TAGTGACTCG GTTCGTTGAT GAGGAATATC TACGATCCAT CAAAAAACAT CGGATCCCGG |
| 2821 GCCCGTCGAC TGCAGAGGCC TGCATGCAAG CTTGGCGTAA TCATGGTCAT AGCTGTTTCC |
| 2881 TGTGTGAAAT TGTTATCCGC TCACAATTCC ACACAACATA CGAGCCGGAA GCATAAAGTG |
| 2941 TAAAGCCTGG GGTGCCTAAT GAGTGAGCTA ACTCACATTA ATTGCGTTGC GCTCACTGCC |
| 3001 CGCTTTCCAG TCGGGAAACC TGTCGTGCCA GCTGCATTAA TGAATCGGCC AACGCGCGGG |
| 3061 GAGAGGCGGT TTGCGTATTG GGCGCTCTTC CGCTTCCTCG CTCACTGACT CGCTGCGCTC |
| 3121 GGTCGTTCGG CTGCGGCGAG CGGTATCAGC TCACTCAAAG GCGGTAATAC GGTTATCCAC |
| 3181 AGAATCAGGG GATAACGCAG GAAAGAACAT GTGAGCAAAA GGCCAGCAAA AGGCCAGGAA |
| 3241 CCGTAAAAAG GCCGCGTTGC TGGCGTTTTT CCATAGGCTC CGCCCCCCTG ACGAGCATCA |
| 3301 CAAAAATCGA CGCTCAAGTC AGAGGTGGCG AAACCCGACA GGACTATAAA GATACCAGGC |
| 3361 GTTTCCCCCT GGAAGCTCCC TCGTGCGCTC TCCTGTTCCG ACCCTGCCGC TTACCGGATA |
| 3421 CCTGTCCGCC TTTCTCCCTT CGGGAAGCGT GGCGCTTTCT CATAGCTCAC GCTGTAGGTA |
| 3481 TCTCAGTTCG GTGTAGGTCG TTCGCTCCAA GCTGGGCTGT GTGCACGAAC CCCCCGTTCA |
| 3541 GCCCGACCGC TGCGCCTTAT CCGGTAACTA TCGTCTTGAG TCCAACCCGG TAAGACACGA |
| 3601 CTTATCGCCA CTGGCAGCAG CCACTGGTAA CAGGATTAGC AGAGCGAGGT ATGTAGGCGG |
| 3661 TGCTACAGAG TTCTTGAAGT GGTGGCCTAA CTACGGCTAC ACTAGAAGAA CAGTATTTGG |
| 3721 TATCTGCGCT CTGCTGAAGC CAGTTACCTT CGGAAAAAGA GTTGGTAGCT CTTGATCCGG |
| 3781 CAAACAAACC ACCGCTGGTA GCGGTGGTTT TTTTGTTTGC AAGCAGCAGA TTACGCGCAG |
| 3841 AAAAAAAGGA TCTCAAGAAG ATCCTTTGAT CTTTTCTACG GGGTCTGACG CTCAGTGGAA |
| 3901 CGAAAACTCA CGTTAAGGGA TTTTGGTCAT GAGATTATCA AAAGGATCTT TCACCTAGAT |

TABLE 1-continued

Exemplary nucleotide sequences for the open reading frames of the recombinant MVA constructs of the present technology.

3961 CCTTTTAAAT TAAAAATGAA GTTTTAAATC AATCTAAAGT ATATATGAGT AAACTTGGTC

4021 TGACAGTTAC CAATGCTTAA TCAGTGAGGC ACCTATCTCA GCGATCTGTC TATTTCGTTC

4081 ATCCATAGTT GCCTGACTCC CCGTCGTGTA GATAACTACG ATACGGGAGG GCTTACCATC

4141 TGGCCCCAGT GCTGCAATGA TACCGCGAGA CCCACGCTCA CCGGCTCCAG ATTTATCAGC

4201 AATAAACCAG CCAGCCGGAA GGGCCGAGCG CAGAAGTGGT CCTGCAACTT TATCCGCCTC

4261 CATCCAGTCT ATTAATTGTT GCCGGGAAGC TAGAGTAAGT AGTTCGCCAG TTAATAGTTT

4321 GCGCAACGTT GTTGCCATTG CTACAGGCAT CGTGGTGTCA CGCTCGTCGT TTGGTATGGC

4381 TTCATTCAGC TCCGGTTCCC AACGATCAAG GCGAGTTACA TGATCCCCCA TGTTGTGCAA

4441 AAAAGCGGTT AGCTCCTTCG GTCCTCCGAT CGTTGTCAGA AGTAAGTTGG CCGCAGTGTT

4501 ATCACTCATG GTTATGGCAG CACTGCATAA TTCTCTTACT GTCATGCCAT CCGTAAGATG

4561 CTTTTCTGTG ACTGGTGAGT ACTCAACCAA GTCATTCTGA GAATAGTGTA TGCGGCGACC

4621 GAGTTGCTCT TGCCCGGCGT CAATACGGGA TAATACCGCG CCACATAGCA GAACTTTAAA

4681 AGTGCTCATC ATTGGAAAAC GTTCTTCGGG GCGAAAACTC TCAAGGATCT TACCGCTGTT

4741 GAGATCCAGT TCGATGTAAC CCACTCGTGC ACCCAACTGA TCTTCAGCAT CTTTTACTTT

4801 CACCAGCGTT TCTGGGTGAG CAAAAACAGG AAGGCAAAAT GCCGCAAAAA AGGGAATAAG

4861 GGCGACACGG AAATGTTGAA TACTCATACT CTTCCTTTTT CAATATTATT GAAGCATTTA

4921 TCAGGGTTAT TGTCTCATGA GCGGATACAT ATTTGAATGT ATTTAGAAAA ATAAACAAAT

4981 AGGGGTTCCG CGCACATTTC CCCGAAAAGT GCCACCTGAC GTCTAAGAAA CCATTATTAT

5041 CATGACATTA ACCTATAAAA ATAGGCGTAT CACGAGGCCC TTTCGTC pUC57-hFlt3L-GFPnucleic acid sequence (also referred to as pUC57-P501-GFP)

(SEQ ID NO: 4)

1 TCGCGCGTTT CGGTGATGAC GGTGAAAACC TCTGACACAT GCAGCTCCCG

51 GAGACGGTCA CAGCTTGTCT GTAAGCGGAT GCCGGGAGCA GACAAGCCCG

101 TCAGGGCGCG TCAGCGGGTG TTGGCGGGTG TCGGGGCTGG CTTAACTATG

151 CGGCATCAGA GCAGATTGTA CTGAGAGTGC ACCATATGCG GTGTGAAATA

201 CCGCACAGAT GCGTAAGGAG AAAATACCGC ATCAGGCGCC ATTCGCCATT

251 CAGGCTGCGC AACTGTTGGG AAGGGCGATC GGTGCGGGCC TCTTCGCTAT

301 TACGCCAGCT GGCGAAAGGG GGATGTGCTG CAAGGCGATT AAGTTGGGTA

351 ACGCCAGGGT TTTCCCAGTC ACGACGTTGT AAAACGACGG CCAGTGAATT

401 CATATTACGA TGGTAACATA TACGATTTAG CTAAAGATAT AAATGCGATG

451 TCATTCGACA GTTTTATAAG ATCTCTACAA AATATCTCTT CAAAGAAAGA

501 TAAACTCACT GTTTATGGAA CCATGGGACT GCTGTCTATT GTCGTAGATA

551 TTAACAAAGG TTGTGATATA TCCAATATCA AGTTCGCTGC CGGAATAATC

601 ATTTTAATGG AGTATATTTT TGATGACACG GATATGTCTC ATCTTAAAGT

651 AGCACTCTAT CGTAGAATAC AGAGACGTGA TGATGTAGAT AGATATTTTT

701 TTTTCCTAAA CTGATTTCTC TGTTTAAATT CGTAGCGATA TATAAAACAA

751 CATGTAATTA ATTAATAAAC TTTAAGACAT GTGTGTTATA CTAAGATGGT

801 TGGCTTATTC CATAGTAGCT TGTGGAATTT ATAAACTTAT GATAGTAAAA

851 CTAGTACCCA ATATGTAAAG ATGAAAAAGT AAATTACTAT TAACGCCGTC

TABLE 1-continued

Exemplary nucleotide sequences for the open reading frames of the recombinant MVA constructs of the present technology.

```
 901 GGTATTCGTT CATCCATTCA GTAAGCTTAA AAATTGAAAT TTTATTTTTT
 951 TTTTTTGGAA TATAAATAAG CTCGAAGTCG ACGAATTCAT GACAGTGCTG
1001 GCGCCAGCCT GGAGCCCAAC AACCTATCTC CTCCTGCTGC TGCTGCTGAG
1051 CTCGGGACTC AGTGGGACCC AGGACTGCTC CTTCCAACAC AGCCCCATCT
1101 CCTCCGACTT CGCTGTCAAA ATCCGTGAGC TGTCTGACTA CCTGCTTCAA
1151 GATTACCCAG TCACCGTGGC CTCCAACCTG CAGGACGAGG AGCTCTGCGG
1201 GGGCCTCTGG CGGCTGGTCC TGGCACAGCG CTGGATGGAG CGGCTCAAGA
1251 CTGTCGCTGG GTCCAAGATG CAAGGCTTGC TGGAGCGCGT GAACACGGAG
1301 ATACACTTTG TCACCAAATG TGCCTTTCAG CCCCCCCCCA GCTGTCTTCG
1351 CTTCGTCCAG ACCAACATCT CCCGCCTCCT GCAGGAGACC TCCGAGCAGC
1401 TGGTGGCGCT GAAGCCCTGG ATCACTCGCC AGAACTTCTC CCGGTGCCTG
1451 GAGCTGCAGT GTCAGCCCGA CTCCTCAACC CTGCCACCCC CATGGAGTCC
1501 CCGGCCCCTG GAGGCCACAG CCCCGACAGC CCCGCAGCCC CCTCTGCTCC
1551 TCCTACTGCT GCTGCCCGTG GGCCTCCTGC TGCTGGCCGC TGCCTGGTGC
1601 CTGCACTGGC AGAGGACGCG GCGGAGGACA CCCCGCCCTG GGGAGCAGGT
1651 GCCCCCCGTC CCCAGTCCCC AGGACCTGCT GCTTGTGGAG CACTGACTCG
1701 AGTTTACTTG TACAGCTCGT CCATGCCGAG AGTGATCCCG GCGGCGGTCA
1751 CGAACTCCAG CAGGACCATG TGATCGCGCT TCTCGTTGGG GTCTTTGCTC
1801 AGGGCGGACT GGGTGCTCAG GTAGTGGTTG TCGGGCAGCA GCACGGGGCC
1851 GTCGCCGATG GGGGTGTTCT GCTGGTAGTG GTCGGCGAGC TGCACGCTGC
1901 CGTCCTCGAT GTTGTGGCGG ATCTTGAAGT TCACCTTGAT GCCGTTCTTC
1951 TGCTTGTCGG CCATGATATA GACGTTGTGG CTGTTGTAGT TGTACTCCAG
2001 CTTGTGCCCC AGGATGTTGC CGTCCTCCTT GAAGTCGATG CCCTTCAGCT
2051 CGATGCGGTT CACCAGGGTG TCGCCCTCGA ACTTCACCTC GGCGCGGGTC
2101 TTGTAGTTGC CGTCGTCCTT GAAGAAGATG GTGCGCTCCT GGACGTAGCC
2151 TTCGGGCATG GCGGACTTGA AGAAGTCGTG CTGCTTCATG TGGTCGGGGT
2201 AGCGGCTGAA GCACTGCACG CCGTAGGTCA GGGTGGTCAC GAGGGTGGGC
2251 CAGGGCACGG GCAGCTTGCC GGTGGTGCAG ATGAACTTCA GGGTCAGCTT
2301 GCCGTAGGTG GCATCGCCCT CGCCCTCGCC GGACACGCTG AACTTGTGGC
2351 CGTTTACGTC GCCGTCCAGC TCGACCAGGA TGGGCACCAC CCCGGTGAAC
2401 AGCTCCTCGC CCTTGCTCAC CATGGTACCA GGCCTAGATC TGTCGACTTC
2451 GAGCTTATTT ATATTCCAAA AAAAAAAAAT AAAATTTCAA TTTTTCTCGA
2501 GTATGAGTAT AGTGTTAAAT GACACTTACT AAATAGCCAA GGTGATTATT
2551 CGTATTTTTT TAAGGAGTAA CCATGTCCGC AATTAGATTT ATTGCATGTC
2601 TATATCTCAT TTCCATCTTC GGAAATTGTC ATGAGGATCC ATATTATCAA
2651 CCATTTGATA AATTAAACAT TACTCTAGAT ATATACACTT ATGAGGATCT
2701 AGTACCATAC ACCGTAGACA ATGACACAAC TTCTTTCGTT AAGATATACT
2751 TTAAAAATTT TTGGATTACG GTTATGACTA AATGGTGTGC TCCGTTTATT
```

TABLE 1-continued

| Exemplary nucleotide sequences for the open reading frames of the recombinant MVA constructs of the present technology. |
|---|
| 2801 GATACCGTTA GCGTATACAC ATCTCATGAT AATCTGAATA TACAATTTTA |
| 2851 TAGTAGGGAC GAATATGATA CACAAAGCGA GGATAAAATT TGTACCATTG |
| 2901 ATGTTAAAGC ACGATGCAAA CATCTAACAA AACGAGAAGT TACAGTACAA |
| 2951 CAAGAAGCCT ACAGATAATC TAGATGCATT CGCGAGGTAC CGAATCGGAT |
| 3001 CCCGGGCCCG TCGACTGCAG AGGCCTGCAT GCAAGCTTGG CGTAATCATG |
| 3051 GTCATAGCTG TTTCCTGTGT GAAATTGTTA TCCGCTCACA ATTCCACACA |
| 3101 ACATACGAGC CGGAAGCATA AAGTGTAAAG CCTGGGGTGC CTAATGAGTG |
| 3151 AGCTAACTCA CATTAATTGC GTTGCGCTCA CTGCCCGCTT TCCAGTCGGG |
| 3201 AAACCTGTCG TGCCAGCTGC ATTAATGAAT CGGCCAACGC GCGGGGAGAG |
| 3251 GCGGTTTGCG TATTGGGCGC TCTTCCGCTT CCTCGCTCAC TGACTCGCTG |
| 3301 CGCTCGGTCG TTCGGCTGCG GCGAGCGGTA TCAGCTCACT CAAAGGCGGT |
| 3351 AATACGGTTA TCCACAGAAT CAGGGGATAA CGCAGGAAAG AACATGTGAG |
| 3401 CAAAAGGCCA GCAAAAGGCC AGGAACCGTA AAAAGGCCGC GTTGCTGGCG |
| 3451 TTTTTCCATA GGCTCCGCCC CCCTGACGAG CATCACAAAA ATCGACGCTC |
| 3501 AAGTCAGAGG TGGCGAAACC CGACAGGACT ATAAAGATAC CAGGCGTTTC |
| 3551 CCCCTGGAAG CTCCCTCGTG CGCTCTCCTG TTCCGACCCT GCCGCTTACC |
| 3601 GGATACCTGT CCGCCTTTCT CCCTTCGGGA AGCGTGGCGC TTTCTCATAG |
| 3651 CTCACGCTGT AGGTATCTCA GTTCGGTGTA GGTCGTTCGC TCCAAGCTGG |
| 3701 GCTGTGTGCA CGAACCCCCC GTTCAGCCCG ACCGCTGCGC CTTATCCGGT |
| 3751 AACTATCGTC TTGAGTCCAA CCCGGTAAGA CACGACTTAT CGCCACTGGC |
| 3801 AGCAGCCACT GGTAACAGGA TTAGCAGAGC GAGGTATGTA GGCGGTGCTA |
| 3851 CAGAGTTCTT GAAGTGGTGG CCTAACTACG GCTACACTAG AAGAACAGTA |
| 3901 TTTGGTATCT GCGCTCTGCT GAAGCCAGTT ACCTTCGGAA AAAGAGTTGG |
| 3951 TAGCTCTTGA TCCGGCAAAC AAACCACCGC TGGTAGCGGT GGTTTTTTTG |
| 4001 TTTGCAAGCA GCAGATTACG CGCAGAAAAA AAGGATCTCA AGAAGATCCT |
| 4051 TTGATCTTTT CTACGGGGTC TGACGCTCAG TGGAACGAAA ACTCACGTTA |
| 4101 AGGGATTTTG GTCATGAGAT TATCAAAAAG GATCTTCACC TAGATCCTTT |
| 4151 TAAATTAAAA ATGAAGTTTT AAATCAATCT AAAGTATATA TGAGTAAACT |
| 4201 TGGTCTGACA GTTACCAATG CTTAATCAGT GAGGCACCTA TCTCAGCGAT |
| 4251 CTGTCTATTT CGTTCATCCA TAGTTGCCTG ACTCCCCGTC GTGTAGATAA |
| 4301 CTACGATACG GGAGGGCTTA CCATCTGGCC CCAGTGCTGC AATGATACCG |
| 4351 CGAGACCCAC GCTCACCGGC TCCAGATTTA TCAGCAATAA ACCAGCCAGC |
| 4401 CGGAAGGGCC GAGCGCAGAA GTGGTCCTGC AACTTTATCC GCCTCCATCC |
| 4451 AGTCTATTAA TTGTTGCCGG GAAGCTAGAG TAAGTAGTTC GCCAGTTAAT |
| 4501 AGTTTGCGCA ACGTTGTTGC CATTGCTACA GGCATCGTGG TGTCACGCTC |
| 4551 GTCGTTTGGT ATGGCTTCAT TCAGCTCCGG TTCCCAACGA TCAAGGCGAG |
| 4601 TTACATGATC CCCCATGTTG TGCAAAAAAG CGGTTAGCTC CTTCGGTCCT |
| 4651 CCGATCGTTG TCAGAAGTAA GTTGGCCGCA GTGTTATCAC TCATGGTTAT |
| 4701 GGCAGCACTG CATAATTCTC TTACTGTCAT GCCATCCGTA AGATGCTTTT |

TABLE 1-continued

Exemplary nucleotide sequences for the open reading frames of the recombinant MVA constructs of the present technology.

| | |
|---|---|
| 4751 | CTGTGACTGG TGAGTACTCA ACCAAGTCAT TCTGAGAATA GTGTATGCGG |
| 4801 | CGACCGAGTT GCTCTTGCCC GGCGTCAATA CGGGATAATA CCGCGCCACA |
| 4851 | TAGCAGAACT TTAAAAGTGC TCATCATTGG AAAACGTTCT TCGGGGCGAA |
| 4901 | AACTCTCAAG GATCTTACCG CTGTTGAGAT CCAGTTCGAT GTAACCCACT |
| 4951 | CGTGCACCCA ACTGATCTTC AGCATCTTTT ACTTTCACCA GCGTTTCTGG |
| 5001 | GTGAGCAAAA ACAGGAAGGC AAAATGCCGC AAAAAAGGGA ATAAGGGCGA |
| 5051 | CACGGAAATG TTGAATACTC ATACTCTTCC TTTTTCAATA TTATTGAAGC |
| 5101 | ATTTATCAGG GTTATTGTCT CATGAGCGGA TACATATTTG AATGTATTTA |
| 5151 | GAAAAATAAA CAAATAGGGG TTCCGCGCAC ATTTCCCCGA AAAGTGCCAC |
| 5201 | CTGACGTCTA AGAAACCATT ATTATCATGA CATTAACCTA TAAAAATAGG |
| 5251 | CGTATCACGA GGCCCTTTCG TC |

The MVA virus genome sequence (SEQ ID NO: 1) given by GenBank Accession No. U94848.1 is provided in FIG. 22. In some embodiments, engineered MVAΔC7L virus expressing OX40L is generated by inserting an expression construct such as those illustrated by SEQ ID NOs: 3 and 5 into the MVA genomic region that corresponds to the position of the TK locus (e.g., position 75,560 to 76,093 of SEQ ID NO: 1). Additionally or alternatively, in some embodiments engineered MVAΔC7L-OX40L is further modified to express hFlt3L by inserting an expression construct such as that which is ilustrated by SEQ ID NO: 4 into the MVA genomic region that corresponds to the C7 locus (e.g., position 18,407 to 18,859 of SEQ ID NO: 1).

MVAΔE3L

The disclosure of the present technology relates to an E3L mutant modified vaccinia Ankara (MVA) virus (i.e., MVAΔE3L; MVA virus comprising an E3L deletion; MVA virus genetically engineered to comprise a mutant E3L gene), or immunogenic compositions comprising the virus, in which the virus is engineered to express one or more specific genes of interest (SG), such as OX40L (MVAΔE3L-OX40L), and their use as a cancer immunotherapeutic. In some embodiments, the thymidine kinase (TK) gene of the MVA virus, through homologous recombination techniques, is engineered to contain a disruption comprising a heterologous nucleic acid sequence comprising one or more expression cassettes, which result in a TK knockout such that the TK gene is not expressed, expressed at levels so low as to have no effect, or the expressed protein is non-functional (e.g., is a null-mutation). The resulting MVAΔE3L-TK(−) virus is further engineered to comprise one or more expression cassettes that are flanked by a partial sequence of the TK gene (TK-L and TK-R) on either side. For example, in some embodiments, the nucleic acid sequence corresponding to the position of TK in the MVAΔE3L genome (e.g., position 75,798 to 75,868 of SEQ ID NO: 1) is replaced with a heterologous nucleic acid sequence comprising an open reading frame that encodes a specific gene of interest (SG), such as human OX40L, resulting in MVAΔE3L-TK(−)-OX40L. In some embodiments, the expression cassette comprises a single open reading frame that encodes a specific gene of interest (SG), such as OX40L using the vaccinia viral synthetic early and late promoter (PsE/L).

Although in certain embodiments described above, the transgene (e.g., OX40L) may be inserted into the TK locus, splitting the TK gene and obliterating it, other suitable integration loci can be selected. For example, MVA encodes several immune modulatory genes, including but not limited to C11, K3, F1, F2, F4, F6, F8, F9, F11, F14.5, J2, A46, E3L, B18R (WR200), E5R, K7R, C12L, B8R, B14R, N1L, C11R, K1L, C16, M1L, N2L, and WR199. Accordingly, in some embodiments, these genes can be deleted to potentially enhance immune activating properties of the virus, and allow insertion of transgenes.

In some embodiments, the recombinant MVAΔE3L-OX40L viruses described above are modified to express at least one other heterologous gene, such as any one or more of hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one other viral gene mutation or deletion, such as any one or more of the following deletions: C7; E3LΔ83N; B2R (ΔB2R), B19R (B18R; ΔWR200); E5R; K7R; C12L (IL18BP); B8R; B14R; N1L; C11R; K1L; M1L; N2L; and/or WR199. In other embodiments, no further heterologous genes are added other than those provided in the name of the virus herein (e.g., OX40L), and/or no further viral genes other than E3L or E3L and TK are disrupted or deleted.

In some embodiments, MVAΔE3L is engineered to express both OX40L and hFlt3L. In some embodiments, the recombinant virus is further modified at the E3 locus, through homologous recombination techniques, to contain a disruption comprising a heterologous nucleic acid sequence comprising one or more expression cassettes, which result in an E3 knockout such that the E3 gene is not expressed, expressed at levels so low as to have no effect, or the expressed protein is non-functional (e.g., is a null-mutation). In some embodiments, the expression cassette comprises a single open reading frame that encodes a specific gene of interest (SG), such as hFlt3L, resulting in MVAΔE3L-hFlt3L-TK(−)-OX40L. In some embodiments, the expression cassette encoding OX40L is inserted into the E3 locus while the expression cassette encoding hFlt3L is inserted into the TK locus.

Additionally or alternatively, in some embodiments, the heterologous nucleic acid sequence comprises an expression cassette comprising two or more open reading frames encoding two or more specific genes of interest, separated by a nucleotide sequence that encodes, in the 5' to 3' direction, a protease cleavage site (e.g., a furin cleavage site) and a 2A peptide (Pep2A) sequence.

Figure 1:
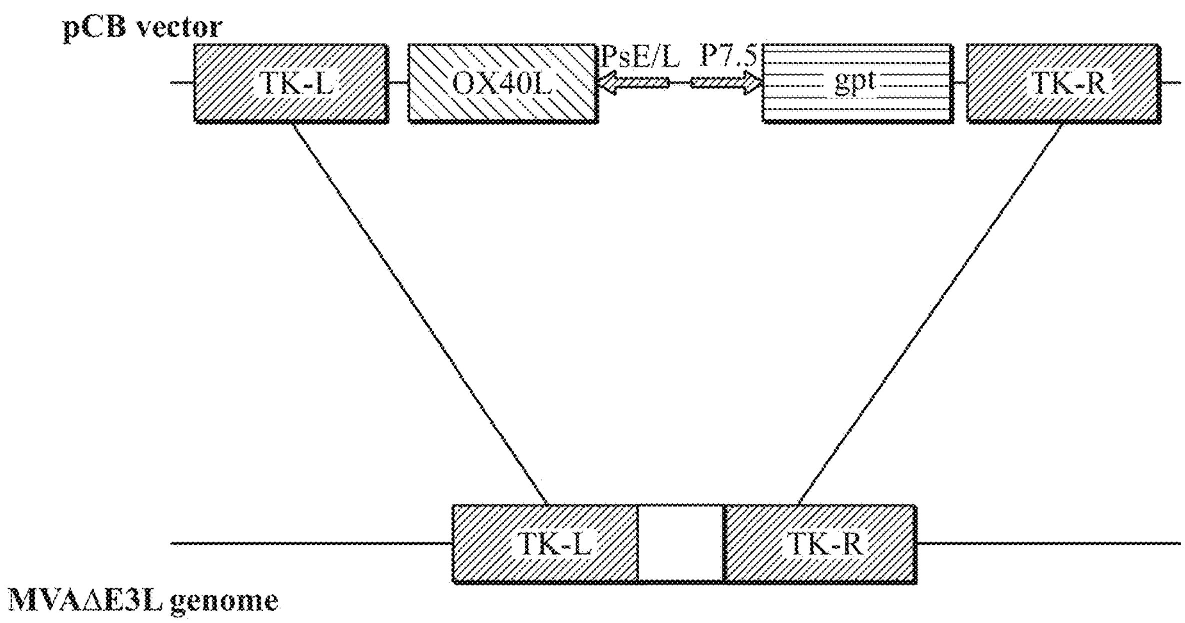
FIG. 1 is a schematic diagram of homologous recombination between plasmid DNA pCB vector and MVAΔE3L viral genomic DNA at the thymidine kinase gene (TK; J2R) locus. pCB-gpt plasmid was used to insert murine OX40L gene under the control of the vaccinia synthetic early and late promoter (PsE/L) into the TK locus. In this case, drug selection marker (gpt) is under the control of the vaccinia p7.5 promoter. The expression cassette was flanked by partial sequence of TK gene flank regions (TK-L and TK-R) on each side.

In some embodiments, the heterologous nucleotide sequence further comprises an additional expression cassette comprising an open reading frame that encodes a selectable marker operably linked to a promoter that is capable of directing expression of the selectable marker (see, e.g., FIG. 1). In some embodiments, the selectable marker is a xanthine-guanine phosphoribosyl transferase (gpt) gene. In some embodiments, the selectable marker is a green fluorescent protein (GFP) gene. In some embodiments, the selectable marker is an mCherry gene encoding a red fluorescent protein.

Non-limiting examples of OX40L expression construct open reading frames according to the present technology are shown above in Table 1.

MVAΔE5R

The disclosure of the present technology relates to an E5R mutant modified vaccinia Ankara (MVA) virus (i.e., MVAΔE5R; MVA virus comprising an E5R deletion; MVA genetically engineered to comprise a mutant E5R gene), or immunogenic compositions comprising the virus, and their use as a cancer immunotherapeutic. In some embodiments, the E5R gene of the MVA virus, through homologous recombination techniques, is engineered to contain a disruption comprising a heterologous nucleic acid sequence comprising one or more expression cassettes, which result in an E5R knockout such that the E5R gene is not expressed, expressed at levels so low as to have no effect, or the expressed protein is non-functional (e.g., is a null-mutation). In some embodiments, the ΔE5R mutant includes a heterologous nucleic acid sequence in place of all or a majority of the E5R gene sequence. For example, in some embodiments, the nucleic acid sequence corresponding to the position of E5R in the MVA genome (e.g., position 38,432 to 39,385 of SEQ ID NO: 1) is replaced with a heterologous nucleic acid sequence comprising an open reading frame that encodes a specific gene of interest (SG), such as human OX40L, resulting in MVAΔE5R-OX40L. In some embodiments, the expression cassette comprises a single open reading frame that encodes hFlt3L, resulting in MVAΔE5R-hFlt3L.

In some embodiments, the MVAΔE5R virus is engineered to express one or more specific genes of interest (SG), such as a heterologous gene selected from any one or more of hOX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one other viral gene mutation or deletion, such as any one or more of the following deletions or mutations: C7 (ΔC7); E3L (ΔE3L); E3LΔ83N; B2R (ΔB2R), B19R (B18R; ΔWR200); E5R (ΔE5R); K7R; C12L (IL18BP); B8R; B14R; N1L; C11R; K1L; M1L; N2L; and/or WR199. In some embodiments, the MVAΔE5R virus is selected from MVAΔE3LΔE5R, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, MVAΔE3LΔE5R-hFlt3L-OX40LΔWR199-hIL-12ΔC11R, MVAΔE3LΔE5R-hFlt3L-OX40LΔWR199-hIL-12ΔC11R-hIL-15/IL-15Rα, or MVAΔE5R-hFlt3L-OX40L-ΔWR199.

In some embodiments, the thymidine kinase (TK) gene of the MVA virus, through homologous recombination techniques, is engineered to contain a disruption comprising a heterologous nucleic acid sequence comprising one or more expression cassettes, which result in a TK knockout such that the TK gene is not expressed, expressed at levels so low as to have no effect, or the expressed protein is non-functional (e.g., is a null-mutation). The resulting MVAΔE5R-TK(−) virus is further engineered to comprise one or more expression cassettes that are flanked by a partial sequence of the TK gene (TK-L and TK-R) on either side. For example, in some embodiments, the nucleic acid sequence corresponding to the position of TK in the MVAΔE5R genome (e.g., position 75,798 to 75,868 of SEQ ID NO: 1) is replaced with a heterologous nucleic acid sequence comprising an open reading frame that encodes a specific gene of interest (SG), such as human OX40L, resulting in MVAΔE5R-TK(−)-OX40L. In some embodiments, the expression cassette comprises a single open reading frame that encodes a specific gene of interest (SG), such as OX40L using the vaccinia viral synthetic early and late promoter (PsE/L).

Although in certain embodiments described above, the transgene (e.g., OX40L) may be inserted into the TK locus, splitting the TK gene and obliterating it, other suitable integration loci can be selected. For example, MVA encodes several immune modulatory genes, including but not limited to C11, K3, F1, F2, F4, F6, F8, F9, F11, F14.5, J2, A46, E3L, B18R (WR200), E5R, K7R, C12L, B8R, B14R, N1L, C11R, K1L, C16, M1L, N2L, and WR199. Accordingly, in some embodiments, these genes can be deleted to potentially enhance immune activating properties of the virus, and allow insertion of transgenes.

In other embodiments, no further heterologous genes are added other than those provided in the name of the virus herein (e.g., OX40L, hFlt3L), and/or no further viral genes other than E5R or E5R and TK are disrupted or deleted.

In some embodiments, MVAΔE5R is engineered to express both OX40L and hFlt3L. In some embodiments, the recombinant virus is further modified at the E5R locus, through homologous recombination techniques, to contain a disruption comprising a heterologous nucleic acid sequence comprising one or more expression cassettes, which result in an E5R knockout such that the E5R gene is not expressed, expressed at levels so low as to have no effect, or the expressed protein is non-functional (e.g., is a null-mutation). In some embodiments, the expression cassette comprises a single open reading frame that encodes a specific gene of interest (SG), such as hFlt3L, resulting in MVAΔE5R-hFlt3L-TK(−)-OX40L. In some embodiments, the expression cassette encoding OX40L is inserted into the E5R locus while the expression cassette encoding hFlt3L is inserted into the TK locus.

Additionally or alternatively, in some embodiments, the heterologous nucleic acid sequence comprises an expression cassette comprising two or more open reading frames encoding two or more specific genes of interest, separated by a nucleotide sequence that encodes, in the 5' to 3' direction, a protease cleavage site (e.g., a furin cleavage site) and a 2A peptide (Pep2A) sequence. For example, in some embodiments, MVAΔE5R encompasses a recombinant MVA in which all or a majority of the E5R gene sequence is replaced by a first specific gene of interest (e.g., hFtl3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as MVAΔE5R-hFl3L-OX40L (see, e.g., FIG. 81).

In some embodiments, the heterologous nucleotide sequence further comprises an additional expression cassette comprising an open reading frame that encodes a selectable marker operably linked to a promoter that is capable of directing expression of the selectable marker. In some embodiments, the selectable marker is a xanthine-guanine phosphoribosyl transferase (gpt) gene. In some embodiments, the selectable marker is a green fluorescent protein (GFP) gene. In some embodiments, the selectable marker is an mCherry gene encoding a red fluorescent protein.

Non-limiting examples of expression and deletion construct open reading frames according to the present technology are shown in (Table 2).

TABLE 2

Exemplary nucleotide sequences for the open reading frames of the recombinant MVAΔE5R constructs of the present technology.

pUC57-MVA-ΔE5R-mCherry vector nucleic acid sequence (SEQ ID NO: 22)

```
   1 TCGCGCGTTT CGGTGATGAC GGTGAAAACC TCTGACACAT GCAGCTCCCG GAGACGGTCA

  61 CAGCTTGTCT GTAAGCGGAT GCCGGGAGCA GACAAGCCCG TCAGGGCGCG TCAGCGGGTG

 121 TTGGCGGGTG TCGGGGCTGG CTTAACTATG CGGCATCAGA GCAGATTGTA CTGAGAGTGC

 181 ACCATATGCG GTGTGAAATA CCGCACAGAT GCGTAAGGAG AAAATACCGC ATCAGGCGCC

 241 ATTCGCCATT CAGGCTGCGC AACTGTTGGG AAGGGCGATC GGTGCGGGCC TCTTCGCTAT

 301 TACGCCAGCT GGCGAAAGGG GGATGTGCTG CAAGGCGATT AAGTTGGGTA ACGCCAGGGT

 361 TTTCCCAGTC ACGACGTTGT AAAACGACGG CCAGTGAATT CGAGCTCGGT ACCgagatag

 421 cgaaggaatt ctttttcggt gccgctagta cccttaatca tatcacatag tgttttatat

 481 tccaaatttg tggcaataga cggtttattt ctatacgata gtttgtttct ggaatccttt

 541 gagtattcta taccaatatt attctttgat tcgaatttag tttcttcgat attagatttt

 601 gtattaccta tattcttgat gtagtacttt gatgattttt ccatggccca ttctattaag

 661 tcttccaagt tggcatcatc cacatattgt gatagtaatt ctcggatatc agtagcggct

 721 accgccattg atgtttgttc attggatgag taactactaa tgtatacatt ttccatttat

 781 aacacttatg tattaacttt gttcatttat atttttcat tattatgttg atattaacaa

 841 aagtgaatat ataagcttga tcaggccttc actaattcca aacccacccg cttttatag

 901 taagtttttc acccataaat aataaataca ataattaatt tctcgtaaaa gtagaaaata

 961 tattctaatt tattgcacgg taaggaagta gatcataact cgacatggtg agcaagggcg

1021 aggaggataa catggccatc atcaaggagt tcatgcgctt caaggtgcac atggagggct

1081 ccgtgaacgg ccacgagttc gagatcgagg gcgagggcga gggccgcccc tacgagggca

1141 cccagaccgc caagctgaag gtgaccaagg gtggccccct gcccttcgcc tgggacatcc

1201 tgtcccctca gttcatgtac ggctccaagg cctacgtgaa gcaccccgcc gacatccccg

1261 actacttgaa gctgtccttc cccgagggct tcaagtggga gcgcgtgatg aacttcgagg

1321 acggcggcgt ggtgaccgtg acccaggact cctccctgca ggacggcgag ttcatctaca

1381 aggtgaagct gcgcggcacc aacttcccct ccgacggccc cgtaatgcag aagaagacca

1441 tgggctggga ggcctcctcc gagcggatgt accccgagga cggcgccctg aagggcgaga

1501 tcaagcagag gctgaagctg aaggacggcg gccactacga cgctgaggtc aagaccacct

1561 acaaggccaa gaagcccgtg cagctgcccg gcgcctacaa cgtcaacatc aagttggaca

1621 tcacctccca caacgaggac tacaccatcg tggaacagta cgaacgcgcc gagggccgcc

1681 actccaccgg cggcatggac gagctGATCA CGAATTgtta acctgcattt catctttctc

1741 caatactaat tcaaattgtt aaattaataa tggatagtat aaatagttat tagtgataaa

1801 atagtaaaaa taattattag aataagagtg tagtatcata gataactctc ttctataaaa

1861 atggatttta ttcgtagaaa gtatcttata tacacagtag aaaataatat agatttttta
```

TABLE 2-continued

| Exemplary nucleotide sequences for the open reading frames of the recombinant MVAΔE5R constructs of the present technology. |
|---|
| 1921 aaggatgata cattaagtaa agtaaacaat tttaccctca atcatgtact agctctcaag |
| 1981 tatctagtta gcaattttcc tcaacacgtt attactaagg atgtattagc taataccaat |
| 2041 ttttttgttt tcatacatat ggtacgatgt tgtaaagtgt acgaagcggt tttacgacac |
| 2101 gcatttgatg cacccacgtt gtacgttaaa gcattgacta agaattattG GATCCCGGGC |
| 2161 CCGTCGACTG CAGAGGCCTG CATGCAAGCT TGGCGTAATC ATGGTCATAG CTGTTTCCTG |
| 2221 TGTGAAATTG TTATCCGCTC ACAATTCCAC ACAACATACG AGCCGGAAGC ATAAAGTGTA |
| 2281 AAGCCTGGGG TGCCTAATGA GTGAGCTAAC TCACATTAAT TGCGTTGCGC TCACTGCCCG |
| 2341 CTTTCCAGTC GGGAAACCTG TCGTGCCAGC TGCATTAATG AATCGGCCAA CGCGCGGGGA |
| 2401 GAGGCGGTTT GCGTATTGGG CGCTCTTCCG CTTCCTCGCT CACTGACTCG CTGCGCTCGG |
| 2461 TCGTTCGGCT GCGGCGAGCG GTATCAGCTC ACTCAAAGGC GGTAATACGG TTATCCACAG |
| 2521 AATCAGGGGA TAACGCAGGA AAGAACATGT GAGCAAAAGG CCAGCAAAAG GCCAGGAACC |
| 2581 GTAAAAAGGC CGCGTTGCTG GCGTTTTTCC ATAGGCTCCG CCCCCCTGAC GAGCATCACA |
| 2641 AAAATCGACG CTCAAGTCAG AGGTGGCGAA ACCCGACAGG ACTATAAAGA TACCAGGCGT |
| 2701 TTCCCCCTGG AAGCTCCCTC GTGCGCTCTC CTGTTCCGAC CCTGCCGCTT ACCGGATACC |
| 2761 TGTCCGCCTT TCTCCCTTCG GGAAGCGTGG CGCTTTCTCA TAGCTCACGC TGTAGGTATC |
| 2821 TCAGTTCGGT GTAGGTCGTT CGCTCCAAGC TGGGCTGTGT GCACGAACCC CCCGTTCAGC |
| 2881 CCGACCGCTG CGCCTTATCC GGTAACTATC GTCTTGAGTC CAACCCGGTA AGACACGACT |
| 2941 TATCGCCACT GGCAGCAGCC ACTGGTAACA GGATTAGCAG AGCGAGGTAT GTAGGCGGTG |
| 3001 CTACAGAGTT CTTGAAGTGG TGGCCTAACT ACGGCTACAC TAGAAGAACA GTATTTGGTA |
| 3061 TCTGCGCTCT GCTGAAGCCA GTTACCTTCG GAAAAAGAGT TGGTAGCTCT TGATCCGGCA |
| 3121 AACAAACCAC CGCTGGTAGC GGTGGTTTTT TTGTTTGCAA GCAGCAGATT ACGCGCAGAA |
| 3181 AAAAAGGATC TCAAGAAGAT CCTTTGATCT TTTCTACGGG GTCTGACGCT CAGTGGAACG |
| 3241 AAAACTCACG TTAAGGGATT TTGGTCATGA GATTATCAAA AAGGATCTTC ACCTAGATCC |
| 3301 TTTTAAATTA AAAATGAAGT TTTAAATCAA TCTAAAGTAT ATATGAGTAA ACTTGGTCTG |
| 3361 ACAGTTACCA ATGCTTAATC AGTGAGGCAC CTATCTCAGC GATCTGTCTA TTTCGTTCAT |
| 3421 CCATAGTTGC CTGACTCCCC GTCGTGTAGA TAACTACGAT ACGGGAGGGC TTACCATCTG |
| 3481 GCCCCAGTGC TGCAATGATA CCGCGAGACC CACGCTCACC GGCTCCAGAT TTATCAGCAA |
| 3541 TAAACCAGCC AGCCGGAAGG GCCGAGCGCA GAAGTGGTCC TGCAACTTTA TCCGCCTCCA |
| 3601 TCCAGTCTAT TAATTGTTGC CGGGAAGCTA GAGTAAGTAG TTCGCCAGTT AATAGTTTGC |
| 3661 GCAACGTTGT TGCCATTGCT ACAGGCATCG TGGTGTCACG CTCGTCGTTT GGTATGGCTT |
| 3721 CATTCAGCTC CGGTTCCCAA CGATCAAGGC GAGTTACATG ATCCCCCATG TTGTGCAAAA |
| 3781 AAGCGGTTAG CTCCTTCGGT CCTCCGATCG TTGTCAGAAG TAAGTTGGCC GCAGTGTTAT |
| 3841 CACTCATGGT TATGGCAGCA CTGCATAATT CTCTTACTGT CATGCCATCC GTAAGATGCT |
| 3901 TTTCTGTGAC TGGTGAGTAC TCAACCAAGT CATTCTGAGA ATAGTGTATG CGGCGACCGA |
| 3961 GTTGCTCTTG CCCGGCGTCA ATACGGGATA ATACCGCGCC ACATAGCAGA ACTTTAAAAG |
| 4021 TGCTCATCAT TGGAAAACGT TCTTCGGGGC GAAAACTCTC AAGGATCTTA CCGCTGTTGA |
| 4081 GATCCAGTTC GATGTAACCC ACTCGTGCAC CCAACTGATC TTCAGCATCT TTTACTTTCA |
| 4141 CCAGCGTTTC TGGGTGAGCA AAAACAGGAA GGCAAAATGC CGCAAAAAAG GGAATAAGGG |

TABLE 2-continued

Exemplary nucleotide sequences for the open reading frames of the recombinant MVAΔE5R constructs of the present technology.

4201 CGACACGGAA ATGTTGAATA CTCATACTCT TCCTTTTTCA ATATTATTGA AGCATTTATC

4261 AGGGTTATTG TCTCATGAGC GGATACATAT TTGAATGTAT TTAGAAAAAT AAACAAATAG

4321 GGGTTCCGCG CACATTTCCC CGAAAAGTGC CACCTGACGT CTAAGAAACC ATTATTATCA

4381 TGACATTAAC CTATAAAAAT AGGCGTATCA CGAGGCCCTT TCGTC pMA-MVA-ΔE5R-hFlt3L-hOX40L vector nucleic acid sequence (SEQ ID NO: 23)

1 CTAAATTGTA AGCGTTAATA TTTTGTTAAA ATTCGCGTTA AATTTTTGTT AAATCAGCTC

61 ATTTTTTAAC CAATAGGCCG AAATCGGCAA AATCCCTTAT AAATCAAAAG AATAGACCGA

121 GATAGGGTTG AGTGGCCGCT ACAGGGCGCT CCCATTCGCC ATTCAGGCTG CGCAACTGTT

181 GGGAAGGGCG TTTCGGTGCG GGCCTCTTCG CTATTACGCC AGCTGGCGAA AGGGGGATGT

241 GCTGCAAGGC GATTAAGTTG GGTAACGCCA GGGTTTTCCC AGTCACGACG TTGTAAAACG

301 ACGGCCAGTG AGCGCGACGT AATACGACTC ACTATAGGGC GAATTGGCGG AAGGCCGTCA

361 AGGCCGCATT GGAGGTTCGT CAGCGGCTCT AGTTTGAATC ATCATCGGCG TAGTATTCCT

421 ACTTTTACAG TTAGGACACG GTGTATTGTA TTTCTCGTCG AGAACGTTAA AATAATCGTT

481 GTAACTCACA TCCTTTATTT TATCTATATT GTATTCTACT CCTTTCTTAA TGCATTTTAT

541 ACCGAATAAG AGATAGCGAA GGAATTCTTT TTCGGTGCCG CTAGTACCCT TAATCATATC

601 ACATAGTGTT TTATATTCCA AATTTGTGGC AATAGACGGT TTATTTCTAT ACGATAGTTT

661 GTTTCTGGAA TCCTTTGAGT ATTCTATACC AATATTATTC TTTGATTCGA ATTTAGTTTC

721 TTCGATATTA GATTTGTAT TACCTATATT CTTGATGTAG TACTTTGATG ATTTTTCCAT

781 GGCCCATTCT ATTAAGTCTT CCAAGTTGGC ATCATCCACA TATTGTGATA GTAATTCTCG

841 GATATCAGTA GCGGCTACCG CCATTGATGT TTGTTCATTG GATGAGTAAC TACTAATGTA

901 TACATTTTCC ATTTATAACA CTTATGTATT AACTTTGTTC ATTTATATTT TTTCATTATT

961 ATGTTGATAT TAACAAAAGT GAATATATGG ATCCAAAAAT TGAAATTTTA TTTTTTTTTT

1021 TTGGAATATA AATAAGCTCG AAGTCGACGA ATTCATGACA GTACTAGCTC CAGCTTGGTC

1081 CCCGACAACA TACCTTCTAC TACTACTATT GCTATCCTCC GGACTATCTG GAACCCAGGA

1141 TTGCTCTTTT CAGCACTCTC CGATCTCGTC TGATTTCGCG GTTAAGATCA GAGAGCTATC

1201 CGACTACTTG CTACAGGATT ACCCAGTAAC CGTCGCGTCC AACCTACAAG ATGAAGAACT

1261 ATGTGGTGGA CTTTGGAGAC TAGTCCTAGC GCAAAGATGG ATGGAAAGAC TTAAGACCGT

1321 AGCGGGATCT AAGATGCAGG GACTACTAGA AAGAGTCAAC ACCGAGATCC ACTTCGTCAC

1381 AAAGTGTGCG TTTCAACCAC CACCGTCCTG TCTAAGATTC GTCCAGACAA ACATCTCCAG

1441 ACTACTACAA GAAACCTCCG AGCAGCTAGT AGCGCTAAAA CCGTGGATCA CAAGACAGAA

1501 CTTCTCGAGA TGTCTAGAGC TACAGTGTCA GCCGGATTCT TCTACATTAC CACCACCATG

1561 GTCACCAAGA CCACTAGAAG CTACAGCTCC AACTGCTCCA CAACCACCAT TGCTACTTTT

1621 GCTATTGCTA CCCGTCGGAT TGCTACTATT AGCTGCTGCT TGGTGTCTAC ACTGGCAGAG

1681 AACTAGAAGA AGAACTCCAA GACCGGGAGA ACAAGTACCA CCAGTACCAT CTCCACAGGA

1741 CCTACTACTA GTCGAGCACA GAAGAAGAAG AAGATCGGGA GCGACCAACT TCTCGCTATT

1801 GAAACAAGCG GGAGATGTCG AAGAAAATCC GGGACCAATG GAAAGAGTAC AGCCGCTAGA

1861 AGAAAACGTA GGAAATGCGG CTAGACCGAG ATTCGAGAGA AACAAGCTAC TATTGGTCGC

1921 GTCCGTCATC CAAGGACTAG GATTGCTATT GTGCTTCACC TACATCTGCC TACACTTCTC

1981 CGCGCTACAA GTCTCTCATA GATACCCGAG AATCCAGTCC ATCAAGGTCC AGTTCACCGA

TABLE 2-continued

| Exemplary nucleotide sequences for the open reading frames of the recombinant MVAΔE5R constructs of the present technology. |
|---|
| 2041 GTACAAGAAA GAGAAGGGAT TCATCCTAAC CTCGCAGAAA GAGGACGAGA TCATGAAGGT |
| 2101 CCAGAACAAC TCCGTCATCA TCAACTGCGA CGGATTCTAC CTAATCTCCC TAAAGGGATA |
| 2161 CTTCTCCCAA GAAGTCAACA TCTCCTTGCA CTACCAGAAG GATGAGGAAC CGCTATTCCA |
| 2221 GCTAAAGAAA GTCAGATCCG TCAACTCCCT AATGGTCGCC TCTCTAACGT ACAAGGACAA |
| 2281 GGTCTACCTA AACGTCACCA CCGACAACAC ATCCCTAGAT GATTTCCACG TAAACGGTGG |
| 2341 AGAGCTAATC CTAATCCATC AGAACCCGGG AGAGTTCTGT GTATTATAAG TTAACAGGCC |
| 2401 TGCATTTCAT CTTTCTCCAA TACTAATTCA AATTGTTAAA TTAATAATGG ATAGTATAAA |
| 2461 TAGTTATTAG TGATAAAATA GTAAAAATAA TTATTAGAAT AAGAGTGTAG TATCATAGAT |
| 2521 AACTCTCTTC TATAAAAATG GATTTTATTC GTAGAAAGTA TCTTATATAC ACAGTAGAAA |
| 2581 ATAATATAGA TTTTTTAAAG GATGATACAT TAAGTAAAGT AAACAATTTT ACCCTCAATC |
| 2641 ATGTACTAGC TCTCAAGTAT CTAGTTAGCA ATTTTCCTCA ACACGTTATT ACTAAGGATG |
| 2701 TATTAGCTAA TACCAATTTT TTTGTTTTCA TACATATGGT ACGATGTTGT AAAGTGTACG |
| 2761 AAGCGGTTTT ACGACACGCA TTTGATGCAC CCACGTTGTA CGTTAAAGCA TTGACTAAGA |
| 2821 ATTATTTATC GTTTAGTAAC GCAATACAAT CGTACAAGGA AACCGTGCAT AAACTAACAC |
| 2881 AAGATGAAAA ATTTTTAGAG GTTGCCGAAT ACATGGACGA ATTAGGAGAA CTTATAGGCG |
| 2941 TAAATTATGA CTTAGTTCTT AATCCATTAT TTCACGGAGG GGAACCCATC AAAGATATGG |
| 3001 AAATCACTGG GCCTCATGGG CCTTCCGCTC ACTGCCCGCT TTCCAGTCGG GAAACCTGTC |
| 3061 GTGCCAGCTG CATTAACATG GTCATAGCTG TTTCCTTGCG TATTGGGCGC TCTCCGCTTC |
| 3121 CTCGCTCACT GACTCGCTGC GCTCGGTCGT TCGGGTAAAG CCTGGGGTGC CTAATGAGCA |
| 3181 AAAGGCCAGC AAAAGGCCAG GAACCGTAAA AAGGCCGCGT TGCTGGCGTT TTTCCATAGG |
| 3241 CTCCGCCCCC CTGACGAGCA TCACAAAAAT CGACGCTCAA GTCAGAGGTG GCGAAACCCG |
| 3301 ACAGGACTAT AAAGATACCA GGCGTTTCCC CCTGGAAGCT CCCTCGTGCG CTCTCCTGTT |
| 3361 CCGACCCTGC CGCTTACCGG ATACCTGTCC GCCTTTCTCC CTTCGGGAAG CGTGGCGCTT |
| 3421 TCTCATAGCT CACGCTGTAG GTATCTCAGT TCGGTGTAGG TCGTTCGCTC CAAGCTGGGC |
| 3481 TGTGTGCACG AACCCCCCGT TCAGCCCGAC CGCTGCGCCT TATCCGGTAA CTATCGTCTT |
| 3541 GAGTCCAACC CGGTAAGACA CGACTTATCG CCACTGGCAG CAGCCACTGG TAACAGGATT |
| 3601 AGCAGAGCGA GGTATGTAGG CGGTGCTACA GAGTTCTTGA AGTGGTGGCC TAACTACGGC |
| 3661 TACACTAGAA GAACAGTATT TGGTATCTGC GCTCTGCTGA AGCCAGTTAC CTTCGGAAAA |
| 3721 AGAGTTGGTA GCTCTTGATC CGGCAAACAA ACCACCGCTG GTAGCGGTGG TTTTTTTGTT |
| 3781 TGCAAGCAGC AGATTACGCG CAGAAAAAAA GGATCTCAAG AAGATCCTTT GATCTTTTCT |
| 3841 ACGGGGTCTG ACGCTCAGTG GAACGAAAAC TCACGTTAAG GGATTTTGGT CATGAGATTA |
| 3901 TCAAAAAGGA TCTTCACCTA GATCCTTTTA AATTAAAAAT GAAGTTTTAA ATCAATCTAA |
| 3961 AGTATATATG AGTAAACTTG GTCTGACAGT TACCAATGCT TAATCAGTGA GGCACCTATC |
| 4021 TCAGCGATCT GTCTATTTCG TTCATCCATA GTTGCCTGAC TCCCCGTCGT GTAGATAACT |
| 4081 ACGATACGGG AGGGCTTACC ATCTGGCCCC AGTGCTGCAA TGATACCGCG AGAACCACGC |
| 4141 TCACCGGCTC CAGATTTATC AGCAATAAAC CAGCCAGCCG GAAGGGCCGA GCGCAGAAGT |
| 4201 GGTCCTGCAA CTTTATCCGC CTCCATCCAG TCTATTAATT GTTGCCGGGA AGCTAGAGTA |
| 4261 AGTAGTTCGC CAGTTAATAG TTTGCGCAAC GTTGTTGCCA TTGCTACAGG CATCGTGGTG |

TABLE 2-continued

Exemplary nucleotide sequences for the open reading frames of the recombinant MVAΔE5R constructs of the present technology.

4321 TCACGCTCGT CGTTTGGTAT GGCTTCATTC AGCTCCGGTT CCCAACGATC AAGGCGAGTT

4381 ACATGATCCC CCATGTTGTG CAAAAAAGCG GTTAGCTCCT TCGGTCCTCC GATCGTTGTC

4441 AGAAGTAAGT TGGCCGCAGT GTTATCACTC ATGGTTATGG CAGCACTGCA TAATTCTCTT

4501 ACTGTCATGC CATCCGTAAG ATGCTTTTCT GTGACTGGTG AGTACTCAAC CAAGTCATTC

4561 TGAGAATAGT GTATGCGGCG ACCGAGTTGC TCTTGCCCGG CGTCAATACG GGATAATACC

4621 GCGCCACATA GCAGAACTTT AAAAGTGCTC ATCATTGGAA AACGTTCTTC GGGGCGAAAA

4681 CTCTCAAGGA TCTTACCGCT GTTGAGATCC AGTTCGATGT AACCCACTCG TGCACCCAAC

4741 TGATCTTCAG CATCTTTTAC TTTCACCAGC GTTTCTGGGT GAGCAAAAAC AGGAAGGCAA

4801 AATGCCGCAA AAAAGGGAAT AAGGGCGACA CGGAAATGTT GAATACTCAT ACTCTTCCTT

4861 TTTCAATATT ATTGAAGCAT TTATCAGGGT TATTGTCTCA TGAGCGGATA CATATTTGAA

4921 TGTATTTAGA AAAATAAACA AATAGGGGTT CCGCGCACAT TTCCCCGAAA AGTGCCAC pMA-MVAΔE5R-hFlt3L-mOX40L vector nucleic acid sequence (SEQ ID NO: 24)

1 CTAAATTGTA AGCGTTAATA TTTTGTTAAA ATTCGCGTTA AATTTTTGTT AAATCAGCTC

61 ATTTTTTAAC CAATAGGCCG AAATCGGCAA AATCCCTTAT AAATCAAAAG AATAGACCGA

121 GATAGGGTTG AGTGGCCGCT ACAGGGCGCT CCCATTCGCC ATTCAGGCTG CGCAACTGTT

181 GGGAAGGGCG TTTCGGTGCG GGCCTCTTCG CTATTACGCC AGCTGGCGAA AGGGGGATGT

241 GCTGCAAGGC GATTAAGTTG GGTAACGCCA GGGTTTTCCC AGTCACGACG TTGTAAAACG

301 ACGGCCAGTG AGCGCGACGT AATACGACTC ACTATAGGGC GAATTGGCGG AAGGCCGTCA

361 AGGCCGCATT GGAGGTTCGT CAGCGGCTCT AGTTTGAATC ATCATCGGCG TAGTATTCCT

421 ACTTTTACAG TTAGGACACG GTGTATTGTA TTTCTCGTCG AGAACGTTAA AATAATCGTT

481 GTAACTCACA TCCTTTATTT TATCTATATT GTATTCTACT CCTTTCTTAA TGCATTTTAT

541 ACCGAATAAG AGATAGCGAA GGAATTCTTT TTCGGTGCCG CTAGTACCCT TAATCATATC

601 ACATAGTGTT TTATATTCCA AATTTGTGGC AATAGACGGT TTATTTCTAT ACGATAGTTT

661 GTTTCTGGAA TCCTTTGAGT ATTCTATACC AATATTATTC TTTGATTCGA ATTTAGTTTC

721 TTCGATATTA GATTTTGTAT TACCTATATT CTTGATGTAG TACTTTGATG ATTTTTCCAT

781 GGCCCATTCT ATTAAGTCTT CCAAGTTGGC ATCATCCACA TATTGTGATA GTAATTCTCG

841 GATATCAGTA GCGGCTACCG CCATTGATGT TTGTTCATTG GATGAGTAAC TACTAATGTA

901 TACATTTTCC ATTTATAACA CTTATGTATT AACTTTGTTC ATTTATATTT TTTCATTATT

961 ATGTTGATAT TAACAAAAGT GAATATATGG ATCCAAAAAT TGAAATTTTA TTTTTTTTTT

1021 TTGGAATATA AATAAGCTCG AAGTCGACGA ATTCATGACA GTACTAGCTC CAGCTTGGTC

1081 CCCGACAACA TACCTTCTAC TACTACTATT GCTATCCTCC GGACTATCTG GAACCCAGGA

1141 TTGCTCTTTT CAGCACTCTC CGATCTCGTC TGATTTCGCG GTTAAGATCA GAGAGCTATC

1201 CGACTACTTG CTACAGGATT ACCCAGTAAC CGTCGCGTCC AACCTACAAG ATGAAGAACT

1261 ATGTGGTGGA CTTTGGAGAC TAGTCCTAGC GCAAAGATGG ATGGAAAGAC TTAAGACCGT

1321 AGCGGGATCT AAGATGCAGG GACTACTAGA AAGAGTCAAC ACCGAGATCC ACTTCGTCAC

1381 AAAGTGTGCG TTTCAACCAC CACCGTCCTG TCTAAGATTC GTCCAGACAA ACATCTCCAG

1441 ACTACTACAA GAAACCTCCG AGCAGCTAGT AGCGCTAAAA CCGTGGATCA CAAGACAGAA

1501 CTTCTCGAGA TGTCTAGAGC TACAGTGTCA GCCGGATTCT TCTACATTAC CACCACCATG

1561 GTCACCAAGA CCACTAGAAG CTACAGCTCC AACTGCTCCA CAACCACCAT TGCTACTTTT

TABLE 2-continued

| Exemplary nucleotide sequences for the open reading frames of the recombinant MVAΔE5R constructs of the present technology. |
|---|
| 1621 GCTATTGCTA CCCGTCGGAT TGCTACTATT AGCTGCTGCT TGGTGTCTAC ACTGGCAGAG |
| 1681 AACTAGAAGA AGAACTCCAA GACCGGGAGA ACAAGTACCA CCAGTACCAT CTCCACAGGA |
| 1741 CCTACTACTA GTCGAGCACA GAAGAAGAAG AAGATCGGGA GCGACCAACT TCTCGCTATT |
| 1801 GAAACAAGCG GGAGATGTCG AAGAAAATCC GGGACCAATG GAGGGCGAGG GGGTCCAGCC |
| 1861 TCTGGACGAG AACCTCGAAA ACGGGTCTCG CCCTCGCTTT AAATGGAAGA AGACTCTTAG |
| 1921 GCTCGTTGTA AGCGGCATCA AGGGGGCCGG TATGTTGCTG TGCTTCATAT ATGTGTGTTT |
| 1981 GCAACTTAGC TCTTCACCTG CAAAAGACCC CCCCATACAA CGCCTTCGGG GGCTGTGAC |
| 2041 CCGCTGTGAA GATGGTCAAT TGTTTATTTC TTCTTACAAG AACGAGTATC AGACGATGGA |
| 2101 AGTCCAGAAT AACTCCGTAG TGATTAAGTG TGACGGACTG TACATCATCT ACTTGAAAGG |
| 2161 ATCTTTTTTC CAGGAGGTCA AAATTGACCT CCACTTCAGG GAGGATCACA ACCCTATCTC |
| 2221 AATCCCTATG TTGAACGACG GCAGAAGAAT CGTCTTTACT GTAGTCGCTT CACTGGCCTT |
| 2281 CAAGGATAAG GTGTACTTGA CCGTAAACGC TCCTGATACC TTGTGCGAGC ATTTGCAAAT |
| 2341 CAACGATGGA GAACTTATCG TTGTCCAACT CACACCAGGT TACTGTGCTC CTGAGGGCAG |
| 2401 TTATCACAGT ACAGTGAACC AAGTCCCACT GTGAGTTAAC AGGCCTGCAT TTCATCTTTC |
| 2461 TCCAATACTA ATTCAAATTG TTAAATTAAT AATGGATAGT ATAAATAGTT ATTAGTGATA |
| 2521 AAATAGTAAA AATAATTATT AGAATAAGAG TGTAGTATCA TAGATAACTC TCTTCTATAA |
| 2581 AAATGGATTT TATTCGTAGA AAGTATCTTA TATACACAGT AGAAAATAAT ATAGATTTTT |
| 2641 TAAAGGATGA TACATTAAGT AAAGTAAACA ATTTTACCCT CAATCATGTA CTAGCTCTCA |
| 2701 AGTATCTAGT TAGCAATTTT CCTCAACACG TTATTACTAA GGATGTATTA GCTAATACCA |
| 2761 ATTTTTTTGT TTTCATACAT ATGGTACGAT GTTGTAAAGT GTACGAAGCG GTTTTACGAC |
| 2821 ACGCATTTGA TGCACCCACG TTGTACGTTA AAGCATTGAC TAAGAATTAT TTATCGTTTA |
| 2881 GTAACGCAAT ACAATCGTAC AAGGAAACCG TGCATAAACT AACACAAGAT GAAAAATTTT |
| 2941 TAGAGGTTGC CGAATACATG GACGAATTAG GAGAACTTAT AGGCGTAAAT TATGACTTAG |
| 3001 TTCTTAATCC ATTATTTCAC GGAGGGGAAC CCATCAAAGA TATGGAAATC ACTGGGCCTC |
| 3061 ATGGGCCTTC CGCTCACTGC CCGCTTTCCA GTCGGGAAAC CTGTCGTGCC AGCTGCATTA |
| 3121 ACATGGTCAT AGCTGTTTCC TTGCGTATTG GGCGCTCTCC GCTTCCTCGC TCACTGACTC |
| 3181 GCTGCGCTCG GTCGTTCGGG TAAAGCCTGG GGTGCCTAAT GAGCAAAAGG CCAGCAAAAG |
| 3241 GCCAGGAACC GTAAAAAGGC CGCGTTGCTG GCGTTTTTCC ATAGGCTCCG CCCCCCTGAC |
| 3301 GAGCATCACA AAAATCGACG CTCAAGTCAG AGGTGGCGAA ACCCGACAGG ACTATAAAGA |
| 3361 TACCAGGCGT TTCCCCCTGG AAGCTCCCTC GTGCGCTCTC CTGTTCCGAC CCTGCCGCTT |
| 3421 ACCGGATACC TGTCCGCCTT TCTCCCTTCG GGAAGCGTGG CGCTTTCTCA TAGCTCACGC |
| 3481 TGTAGGTATC TCAGTTCGGT GTAGGTCGTT CGCTCCAAGC TGGGCTGTGT GCACGAACCC |
| 3541 CCCGTTCAGC CCGACCGCTG CGCCTTATCC GGTAACTATC GTCTTGAGTC CAACCCGGTA |
| 3601 AGACACGACT TATCGCCACT GGCAGCAGCC ACTGGTAACA GGATTAGCAG AGCGAGGTAT |
| 3661 GTAGGCGGTG CTACAGAGTT CTTGAAGTGG TGGCCTAACT ACGGCTACAC TAGAAGAACA |
| 3721 GTATTTGGTA TCTGCGCTCT GCTGAAGCCA GTTACCTTCG GAAAAAGAGT TGGTAGCTCT |
| 3781 TGATCCGGCA AACAAACCAC CGCTGGTAGC GGTGGTTTTT TTGTTTGCAA GCAGCAGATT |
| 3841 ACGCGCAGAA AAAAAGGATC TCAAGAAGAT CCTTTGATCT TTTCTACGGG GTCTGACGCT |

TABLE 2-continued

Exemplary nucleotide sequences for the open reading frames of the recombinant MVAΔE5R constructs of the present technology.

3901 CAGTGGAACG AAAACTCACG TTAAGGGATT TTGGTCATGA GATTATCAAA AAGGATCTTC

3961 ACCTAGATCC TTTTAAATTA AAAATGAAGT TTTAAATCAA TCTAAAGTAT ATATGAGTAA

4021 ACTTGGTCTG ACAGTTACCA ATGCTTAATC AGTGAGGCAC CTATCTCAGC GATCTGTCTA

4081 TTTCGTTCAT CCATAGTTGC CTGACTCCCC GTCGTGTAGA TAACTACGAT ACGGGAGGGC

4141 TTACCATCTG GCCCCAGTGC TGCAATGATA CCGCGAGAAC CACGCTCACC GGCTCCAGAT

4201 TTATCAGCAA TAAACCAGCC AGCCGGAAGG GCCGAGCGCA GAAGTGGTCC TGCAACTTTA

4261 TCCGCCTCCA TCCAGTCTAT TAATTGTTGC CGGGAAGCTA GAGTAAGTAG TTCGCCAGTT

4321 AATAGTTTGC GCAACGTTGT TGCCATTGCT ACAGGCATCG TGGTGTCACG CTCGTCGTTT

4381 GGTATGGCTT CATTCAGCTC CGGTTCCCAA CGATCAAGGC GAGTTACATG ATCCCCCATG

4441 TTGTGCAAAA AAGCGGTTAG CTCCTTCGGT CCTCCGATCG TTGTCAGAAG TAAGTTGGCC

4501 GCAGTGTTAT CACTCATGGT TATGGCAGCA CTGCATAATT CTCTTACTGT CATGCCATCC

4561 GTAAGATGCT TTTCTGTGAC TGGTGAGTAC TCAACCAAGT CATTCTGAGA ATAGTGTATG

4621 CGGCGACCGA GTTGCTCTTG CCCGGCGTCA ATACGGGATA ATACCGCGCC ACATAGCAGA

4681 ACTTTAAAAG TGCTCATCAT TGGAAAACGT TCTTCGGGGC GAAAACTCTC AAGGATCTTA

4741 CCGCTGTTGA GATCCAGTTC GATGTAACCC ACTCGTGCAC CCAACTGATC TTCAGCATCT

4801 TTTACTTTCA CCAGCGTTTC TGGGTGAGCA AAAACAGGAA GGCAAAATGC CGCAAAAAAG

4861 GGAATAAGGG CGACACGGAA ATGTTGAATA CTCATACTCT TCCTTTTTCA ATATTATTGA

4921 AGCATTTATC AGGGTTATTG TCTCATGAGC GGATACATAT TTGAATGTAT TTAGAAAAAT

4981 AAACAAATAG GGGTTCCGCG CACATTTCCC CGAAAAGTGC CAC

E3L-FRT mCherry Kan Plasmid nucleic acid sequence (SEQ ID NO: 31)

ATAGCGTCCCTAGGACGAACTACTGCCATTAATATCTCTATTATAGCTTCTGGACATAATTCATC

TATTATACCAGAATTAATGGGAACTATTCCGTATCTATCTAACATAGTTTTAAGAAAGTCAGAAT

CTAAGACCTGATGTTCATATATTGGTTCATACATGAAATGATCTCTATTGATGATAGTGACTATT

TCATTCTCTGAAAATTGGTAACTCATTCTATATATGCTTTCCTTGTTGATGAAGGATAGAATATA

CTCAATAGAATTTGTACCAACAAACTGTTCTCTTATGAATCGTATATCATCATCTGAAATAATCA

TGTAAGGCATACATTTAACAATTAGAGACTTGTCTCCTGTTATCAATATACTATTCTTGTGATAA

TTTATGTGTGAGGCAAATTTGTCCACGTTCTTTAATTTTGTTATAGTAGATATCAAATCCAATGG

AGCTACAGTTCTTGGCTTAAACAGATATAGTTTTTCTGGAACGAATTCTACAACATTATTATAAA

GGACTTTGGGTAGATAAGTGGGATGAAATCCTATTTTAATTAATGCGATAGCCTTGTCCTCGTGC

AGATATCCAAACGCTTTTGTGATAGTATGGCATTCATTGTCTAGAAACGCTCTACGAATATCTGT

GACAGATATCATCTTTAGAGAATATACTAGTCGCGTTAATAGTACTACAATTTGTATTTTTTAAT

CTATCTCAATAAAAAAATTAATATGTATGATTCAATGTATAACTAAACTACTAACTGTTATTGAT

AACTAGAATCAGAATCTAATGATGACGTAACCAAGCTAGCGCGGTTAACCGCCTTTTTATCCAT

CAGGTGATCTGTTTTTATTGTGGAGTCTAGAACTAGTGGATCCCCCGGGCTGCAGGAATTCGAT

ATCAAGCTCAGGCCTAGATCTGTCGACTTCGAGCTTATTTATATTCCAAAAAAAAAAAAATAAAA

TTTCAATTTTTAAGCTTTTGAAGTTCCTATACTTTCTAGAGAATAGGAACTTCCACTAATTCCAA

ACCCACCCGCTTTTTATAGTAAGTTTTTCACCCATAAATAATAAATACAATAATTAATTTCTCGT

AAAAGTAGAAAATATATTCTAATTTATTGCACGGTAAGGAAGTAGATCATAACTCGAGGAATTG

GGGATCTCTATAATCTCGCGCAACCTATTTTCCCCTCGAACACTTTTTAAGCCGTAGATAAACAG

TABLE 2-continued

Exemplary nucleotide sequences for the open reading frames of the recombinant MVAΔE5R constructs of the present technology.

GCTGGGACACTTCACACGCGTATGGTGAGCAAGGGCGAGGAGGATAACATGGCCATCATCAAG

GAGTTCATGCGCTTCAAGGTGCACATGGAGGGCTCCGTGAACGGCCACGAGTTCGAGATCGAG

GGCGAGGGCGAGGGCCGCCCCTACGAGGGCACCCAGACCGCCAAGCTGAAGGTGACCAAGGGT

GGCCCCCTGCCCTTCGCCTGGGACATCCTGTCCCCTCAGTTCATGTACGGCTCCAAGGCCTACGT

GAAGCACCCCGCCGACATCCCCGACTACTTGAAGCTGTCCTTCCCCGAGGGCTTCAAGTGGGAG

CGCGTGATGAACTTCGAGGACGGCGGCGTGGTGACCGTGACCCAGGACTCCTCCCTGCAGGAC

GGCGAGTTCATCTACAAGGTGAAGCTGCGCGGCACCAACTTCCCCTCCGACGGCCCCGTAATGC

AGAAGAAGACCATGGGCTGGGAGGCCTCCTCCGAGCGGATGTACCCCGAGGACGGCGCCCTGA

AGGGCGAGATCAAGCAGAGGCTGAAGCTGAAGGACGGCGGCCACTACGACGCTGAGGTCAAG

ACCACCTACAAGGCCAAGAAGCCCGTGCAGCTGCCCGGCGCCTACAACGTCAACATCAAGTTG

GACATCACCTCCCACAACGAGGACTACACCATCGTGGAACAGTACGAACGCGCCGAGGGCCGC

CACTCCACCGGCGGCATGGACGAGCTGTACAAGTAATGAAGTTCCTATACTTTCTAGAGAATAG

GAACTTCCGGTTAACCGGTGATATAGGCAACCAGCAATAAAACTAATTTATTTTATCATTTTTTT

ATTCATCATCCTCTGGTGGTTCGTCGTTTCTATCGAATGTGGATCTGATTAACCCGTCATCTATA

GGTGATGCTGGTTCTGGAGATTCTGGAGGAGATGGATTATTATCTGGAAGAATCTCTGTTATTTC

CTTGTTTTCATGTATCGATTGCGTTGTAACATTAAGATTGCGAAATGCTCTAAATTTGGGAGGCT

TAAAGTGTTGTTTGCAATCTCTACACGCATGTCTAACTAGTGGAGGTTCGTCAGCGGCTCTAGTT

TGAATCATCATCGGCGTAGTATTCCTACTTTTACAGTTAGGACACGGTGTATTGTATTTCTCGTC

GAGAACGTTAAAATAATCGTTGTAACTCACATCCTTTATTTTATCTATATTGTATTCTACTCCTTT

CTTAATGCATTTTATACCGAATAAGAGATAGCGAAGGAATTCTTTTTCGGTGCCGCTAGTACCCT

TAATCATATCACATAGTGTTTTATATTCCAAATTTGTGGCAATAGACGGTTTATTTCTATACGAT

AGTTTGTTTCTGGAATCCTTTGAGTATTCTATACCAATATTATTCTTTGATTCGAATTTAGTTTCT

TCGATATTAGATTTTGTATTACCTATATTCTTGATGTAGTACTTTGATGATTTTTCCATGGCCCAT

TCTATCACGTAGAAAGCCAGTCCGCAGAAACGGTGCTGACCCCGGATGAATGTCAGCTACTGGG

CTATCTGGACAAGGGAAAACGCAAGCGCAAAGAGAAAGCAGGTAGCTTGCAGTGGGCTTACAT

GGCGATAGCTAGACTGGGCGGTTTTATGGACAGCAAGCGAACCGGAATTGCCAGCTGGGGCGC

CCTCTGGTAAGGTTGGGAAGCCCTGCAAAGTAAACTGGATGGCTTTCTCGCCGCCAAGGATCTG

ATGGCGCAGGGGATCAAGCTCTGATCAAGAGACAGGATGAGGATCGTTTCGCATGATTGAACA

AGATGGATTGCACGCAGGTTCTCCGGCCGCTTGGGTGGAGAGGCTATTCGGCTATGACTGGGCA

CAACAGACAATCGGCTGCTCTGATGCCGCCGTGTTCCGGCTGTCAGCGCAGGGGCGCCCGGTTC

TTTTTGTCAAGACCGACCTGTCCGGTGCCCTGAATGAACTGCAAGACGAGGCAGCGCGGCTATC

GTGGCTGGCCACGACGGGCGTTCCTTGCGCAGCTGTGCTCGACGTTGTCACTGAAGCGGGAAGG

GACTGGCTGCTATTGGGCGAAGTGCCGGGGCAGGATCTCCTGTCATCTCACCTTGCTCCTGCCG

AGAAAGTATCCATCATGGCTGATGCAATGCGGCGGCTGCATACGCTTGATCCGGCTACCTGCCC

ATTCGACCACCAAGCGAAACATCGCATCGAGCGAGCACGTACTCGGATGGAAGCCGGTCTTGTC

GATCAGGATGATCTGGACGAAGAGCATCAGGGGCTCGCGCCAGCCGAACTGTTCGCCAGGCTC

AAGGCGAGCATGCCCGACGGCGAGGATCTCGTCGTGACCCATGGCGATGCCTGCTTGCCGAATA

TCATGGTGGAAAATGGCCGCTTTTCTGGATTCATCGACTGTGGCCGGCTGGGTGTGGCGGACCG

TABLE 2-continued

| Exemplary nucleotide sequences for the open reading frames of the recombinant MVAΔE5R constructs of the present technology. |
|---|
| CTATCAGGACATAGCGTTGGCTACCCGTGATATTGCTGAAGAGCTTGGCGGCGAATGGGCTGAC |
| CGCTTCCTCGTGCTTTACGGTATCGCCGCTCCCGATTCGCAGCGCATCGCCTTCTATCGCCTTCTT |
| GACGAGTTCTTCTGAATTATTAACGCTTACAATTTCCTGATGCGGTATTTTCTCCTTACGCATCTG |
| TGCGGTATTTCACACCGCATACAGGTGGCACTTTTCGGGGAAATGTGCGCGGAACCCCTATTTTC |
| GTTCCACTGAGCGTCAGACCCCGTAGAAAAGATCAAAGGATCTTCTTGAGATCCTTTTTTTCTGC |
| GCGTAATCTGCTGCTTGCAAACAAAAAAACCACCGCTACCAGCGGTGGTTTGTTTGCCGGATCA |
| AGAGCTACCAACTCTTTTTCCGAAGGTAACTGGCTTCAGCAGAGCGCAGATACCAAATACTGTC |
| CTTCTAGTGTAGCCGTAGTTAGGCCACCACTTCAAGAACTCTGTAGCACCGCCTACATACCTCGC |
| TCTGCTAATCCTGTTACCAGTGGCTGCTGCCAGTGGCGATAAGTCGTGTCTTACCGGGTTGGACT |
| CAAGACGATAGTTACCGGATAAGGCGCAGCGGTCGGGCTGAACGGGGGGTTCGTGCACACAGC |
| CCAGCTTGGAGCGAACGACCTACACCGAACTGAGATACCTACAGCGTGAGCTATGAGAAAGCG |
| CCACGCTTCCCGAAGGGAGAAAGGCGGACAGGTATCCGGTAAGCGGCAGGGTCGGAACAGGA |
| GAGCGCACGAGGGAGCTTCCAGGGGGAAACGCCTGGTATCTTTATAGTCCTGTCGGGTTTCGCC |
| ACCTCTGACTTGAGCGTCGATTTTTGTGATGCTCGTCAGGGGGGCGGAGCCTATGGAAAAACGC |
| CAGCAACGCGGCCTTTTTACGGTTCCTGGGCTTTTGCTGGCCTTTTGCTCACATGTTCTTTCCTGC |
| GTTATCCCCTGATTCTGTGGATAACCGTATTACCGCCTTTGAGTGAGCTGATACCGCTCGCCGCA |
| GCCGAACGACCGAGCGCAGCGAGTCA |
| E5R-FRT GFP Kan plasmid nucleic acid sequence (SEQ ID NO: 32) |
| TAGTGGAGGTTCGTCAGCGGCTCTAGTTTGAATCATCATCGGCGTAGTATTCCTACTTTTACAGT |
| TAGGACACGGTGTATTGTATTTCTCGTCGAGAACGTTAAAATAATCGTTGTAACTCACATCCTTT |
| ATTTTATCTATATTGTATTCTACTCCTTTCTTAATGCATTTTATACCGAATAAGAGATAGCGAAG |
| GAATTCTTTTTCGGTGCCGCTAGTACCCTTAATCATATCACATAGTGTTTTATATTCCAAATTTGT |
| GGCAATAGACGGTTTATTTCTATACGATAGTTTGTTTCTGGAATCCTTTGAGTATTCTATACCAA |
| TATTATTCTTTGATTCGAATTTAGTTTCTTCGATATTAGATTTTGTATTACCTATATTCTTGATGTA |
| GTACTTTGATGATTTTTCCATGGCCCATTCTATTAAGTCTTCCAAGTTGGCATCATCCACATATTG |
| TGATAGTAATTCTCGGATATCAGTAGCGGCTACCGCCATTGATGTTTGTTCATTGGATGAGTAAC |
| TACTAATGTATACATTTTCCATTTATAACACTTATGTATTAACTTTGTTCATTTATATTTTTTCATT |
| ATTATGTTGATATTAACAAAAGTGAATATAAGCTAGCGCGGTTAACCGCCTTTTTATCCATCAGG |
| TGATCTGTTTTTATTGTGGAGTCTAGAACTAGTGGATCCCCCGGGCTGCAGGAATTCGATATCAA |
| GCTCAGGCCTAGATCTGTCGACTTCGAGCTTATTTATATTCCAAAAAAAAAAAATAAAATTTCA |
| ATTTTTAAGCTTTTGAAGTTCCTATACTTTCTAGAGAATAGGAACTTCCACTAATTCCAAACCCA |
| CCCGCTTTTTATAGTAAGTTTTTCACCCATAAATAATAAATACAATAATTAATTTCTCGTAAAAG |
| TAGAAAATATATTCTAATTTATTGCACGGTAAGGAAGTAGATCATAACTCGAGGAATTGGGGAT |
| CTCTATAATCTCGCGCAACCTATTTTCCCCTCGAACACTTTTTAAGCCGTAGATAAACAGGCTGG |
| GACACTTCACACGCGTATGGTGAGCAAGGGCGAGGAGCTGTTCACCGGGGTGGTGCCCATCCTG |
| GTCGAGCTGGACGGCGACGTAAACGGCCACAAGTTCAGCGTGTCCGGCGAGGGCGAGGGCGAT |
| GCCACCTACGGCAAGCTGACCCTGAAGTTCATCTGCACCACCGGCAAGCTGCCCGTGCCCTGGC |
| CCACCCTCGTGACCACCCTGACCTACGGCGTGCAGTGCTTCAGCCGCTACCCCGACCACATGAA |
| GCAGCACGACTTCTTCAAGTCCGCCATGCCCGAAGGCTACGTCCAGGAGCGCACCATCTTCTTC |

TABLE 2-continued

| Exemplary nucleotide sequences for the open reading frames of the recombinant MVAΔE5R constructs of the present technology. |
|---|

AAGGACGACGGCAACTACAAGACCCGCGCCGAGGTGAAGTTCGAGGGCGACACCCTGGTGAAC

CGCATCGAGCTGAAGGGCATCGACTTCAAGGAGGACGGCAACATCCTGGGGCACAAGCTGGAG

TACAACTACAACAGCCACAACGTCTATATCATGGCCGACAAGCAGAAGAACGGCATCAAGGTG

AACTTCAAGATCCGCCACAACATCGAGGACGGCAGCGTGCAGCTCGCCGACCACTACCAGCAG

AACACCCCCATCGGCGACGGCCCCGTGCTGCTGCCCGACAACCACTACCTGAGCACCCAGTCCA

AGCTGAGCAAAGACCCCAACGAGAAGCGCGATCACATGGTCCTGCTGGAGTTCGTGACCGCCG

CCGGGATCACTCTCGGCATGGACGAGCTGTACAAGTAATGAAGTTCCTATACTTTCTAGAGAAT

AGGAACTTCCGGTTAACCGGTGATATTTCATCTTTCTCCAATACTAATTCAAATTGTTAAATTAA

TAATGGATAGTATAAATAGTTATTAGTGATAAAATAGTAAAAATAATTATTAGAATAAGAGTGT

AGTATCATAGATAACTCTCTTCTATAAAAATGGATTTTATTCGTAGAAAGTATCTTATATACACA

GTAGAAAATAATATAGATTTTTTAAAGGATGATACATTAAGTAAAGTAAACAATTTTACCCTCA

ATCATGTACTAGCTCTCAAGTATCTAGTTAGCAATTTTCCTCAACACGTTATTACTAAGGATGTA

TTAGCTAATACCAATTTTTTTGTTTTCATACATATGGTACGATGTTGTAAAGTGTACGAAGCGGT

TTTACGACACGCATTTGATGCACCCACGTTGTACGTTAAAGCATTGACTAAGAATTATTTATCGT

TTAGTAACGCAATACAATCGTACAAGGAAACCGTGCATAAACTAACACAAGATGAAAAATTTTT

AGAGGTTGCCGAATACATGGACGAATTAGGAGAACTTATAGGCGTAAATTATGACTTAGTTCTT

AATCCATTATTTCACGGAGGGGAACCCATCAAAGATATGGAAATCATTTTTTTAAAACTGTTTA

AGAAAACAGACTTCAAAGTTGTTAAAAAATTAAGTGTTATAAGATTACTTATTTGGGCTTACCT

AAGCAAGAAAGATACAGGTCACGTAGAAAGCCAGTCCGCAGAAACGGTGCTGACCCCGGATGA

ATGTCAGCTACTGGGCTATCTGGACAAGGGAAAACGCAAGCGCAAAGAGAAAGCAGGTAGCTT

GCAGTGGGCTTACATGGCGATAGCTAGACTGGGCGGTTTTATGGACAGCAAGCGAACCGGAATT

GCCAGCTGGGGCGCCCTCTGGTAAGGTTGGGAAGCCCTGCAAAGTAAACTGGATGGCTTTCTCG

CCGCCAAGGATCTGATGGCGCAGGGGATCAAGCTCTGATCAAGAGACAGGATGAGGATCGTTT

CGCATGATTGAACAAGATGGATTGCACGCAGGTTCTCCGGCCGCTTGGGTGGAGAGGCTATTCG

GCTATGACTGGGCACAACAGACAATCGGCTGCTCTGATGCCGCCGTGTTCCGGCTGTCAGCGCA

GGGGCGCCCGGTTCTTTTTGTCAAGACCGACCTGTCCGGTGCCCTGAATGAACTGCAAGACGAG

GCAGCGCGGCTATCGTGGCTGGCCACGACGGGCGTTCCTTGCGCAGCTGTGCTCGACGTTGTCA

CTGAAGCGGGAAGGGACTGGCTGCTATTGGGCGAAGTGCCGGGGCAGGATCTCCTGTCATCTCA

CCTTGCTCCTGCCGAGAAAGTATCCATCATGGCTGATGCAATGCGGCGGCTGCATACGCTTGAT

CCGGCTACCTGCCCATTCGACCACCAAGCGAAACATCGCATCGAGCGAGCACGTACTCGGATGG

AAGCCGGTCTTGTCGATCAGGATGATCTGGACGAAGAGCATCAGGGGCTCGCGCCAGCCGAAC

TGTTCGCCAGGCTCAAGGCGAGCATGCCCGACGGCGAGGATCTCGTCGTGACCCATGGCGATGC

CTGCTTGCCGAATATCATGGTGGAAAATGGCCGCTTTTCTGGATTCATCGACTGTGGCCGGCTGG

GTGTGGCGGACCGCTATCAGGACATAGCGTTGGCTACCCGTGATATTGCTGAAGAGCTTGGCGG

CGAATGGGCTGACCGCTTCCTCGTGCTTTACGGTATCGCCGCTCCCGATTCGCAGCGCATCGCCT

TCTATCGCCTTCTTGACGAGTTCTTCTGAATTATTAACGCTTACAATTTCCTGATGCGGTATTTTC

TCCTTACGCATCTGTGCGGTATTTCACACCGCATACAGGTGGCACTTTTCGGGGAAATGTGCGCG

GAACCCCTATTTTCGTTCCACTGAGCGTCAGACCCCGTAGAAAAGATCAAAGGATCTTCTTGAG

TABLE 2-continued

Exemplary nucleotide sequences for the open reading frames of the recombinant MVAΔE5R constructs of the present technology.

ATCCTTTTTTTCTGCGCGTAATCTGCTGCTTGCAAACAAAAAAACCACCGCTACCAGCGGTGGTT

TGTTTGCCGGATCAAGAGCTACCAACTCTTTTTCCGAAGGTAACTGGCTTCAGCAGAGCGCAGA

TACCAAATACTGTCCTTCTAGTGTAGCCGTAGTTAGGCCACCACTTCAAGAACTCTGTAGCACCG

CCTACATACCTCGCTCTGCTAATCCTGTTACCAGTGGCTGCTGCCAGTGGCGATAAGTCGTGTCT

TACCGGGTTGGACTCAAGACGATAGTTACCGGATAAGGCGCAGCGGTCGGGCTGAACGGGGGG

TTCGTGCACACAGCCCAGCTTGGAGCGAACGACCTACACCGAACTGAGATACCTACAGCGTGA

GCTATGAGAAAGCGCCACGCTTCCCGAAGGGAGAAAGGCGGACAGGTATCCGGTAAGCGGCAG

GGTCGGAACAGGAGAGCGCACGAGGGAGCTTCCAGGGGGAAACGCCTGGTATCTTTATAGTCC

TGTCGGGTTTCGCCACCTCTGACTTGAGCGTCGATTTTTGTGATGCTCGTCAGGGGGGCGGAGCC

TATGGAAAAACGCCAGCAACGCGGCCTTTTTACGGTTCCTGGGCTTTTGCTGGCCTTTTGCTCAC

ATGTTCTTTCCTGCGTTATCCCCTGATTCTGTGGATAACCGTATTACCGCCTTTGAGTGAGCTGAT

ACCGCTCGCCGCAGCCGAACGACCGAGCGCAGCGAGTCA

C11L-FRT mCherry Kan plasmid nucleic acid sequence (SEQ ID NO: 33)

ATTGGAGACGTAACAATGTAGCGCATTGTTTCCTCGTCTATCTATATGTTTTGATAAGTIGTGAC

ACGTTTCAATTTCTAGTTTTATTTTTTTGTACGTCACATCTTCATCCAGTAGACGACATAGAATAC

ATGTGCAATCCATAGCTATTCTGGTGCTAATTATTCCTCATAAGATGATAAAAAGTGTAGTGAG

AGAGCATGAAGGAGATTTAGTATTTAGCAGTGCGGATATGATCCAAGAGGGTGAGATAGTCGTT

CTCGTTCAGAATCTTTCGCAGCATAAGTAGTATGTCGATATACTTATCGTTGAAGACTCTTCCAG

AGACGATAGCTGATTGAGTACAAAGTCCAATGATTGCACGAAGTTCTTCGGCGGTTTTCATGGA

GTCATTTCTGATGAAACATTTAATGATCTAAATTTCAGTTTATGTTTGTACCCCGTATTCATACTT

AACAAATTGGTATTACATACCATTAATAATGCAAGCATAAAAAATCGTTAGTAGATGTTTCTAA

ATATAGGTTCCGTAAGCTAGCGCGGTTAACCGCCTTTTTATCCATCAGGTGATCTGTTTTTATTG

TGGAGTCTAGAACTAGTGGATCCCCCGGGCTGCAGGAATTCGATATCAAGCTCAGGCCTAGATC

TGTCGACTTCGAGCTTATTTATATTCCAAAAAAAAAAAATAAAATTTCAATTTTTAAGCTTTTGA

AGTTCCTATACTTTCTAGAGAATAGGAACTTCCACTAATTCCAAACCCACCCGCTTTTTATAGTA

AGTTTTTCACCCATAAATAATAAATACAATAATTAATTTCTCGTAAAAGTAGAAAATATATTCTA

ATTTATTGCACGGTAAGGAAGTAGATCATAACTCGAGGAATTGGGGATCTCTATAATCTCGCGC

AACCTATTTTCCCCTCGAACACTTTTTAAGCCGTAGATAAACAGGCTGGGACACTTCACACGCGT

ATGGTGAGCAAGGGCGAGGAGGATAACATGGCCATCATCAAGGAGTTCATGCGCTTCAAGGTG

CACATGGAGGGCTCCGTGAACGGCCACGAGTTCGAGATCGAGGGCGAGGGCGAGGGCCGCCCC

TACGAGGGCACCCAGACCGCCAAGCTGAAGGTGACCAAGGGTGGCCCCCTGCCCTTCGCCTGG

GACATCCTGTCCCCTCAGTTCATGTACGGCTCCAAGGCCTACGTGAAGCACCCCGCCGACATCC

CCGACTACTTGAAGCTGTCCTTCCCCGAGGGCTTCAAGTGGGAGCGCGTGATGAACTTCGAGGA

CGGCGGCGTGGTGACCGTGACCCAGGACTCCTCCCTGCAGGACGGCGAGTTCATCTACAAGGTG

AAGCTGCGCGGCACCAACTTCCCCTCCGACGGCCCCGTAATGCAGAAGAAGACCATGGGCTGG

GAGGCCTCCTCCGAGCGGATGTACCCCGAGGACGGCGCCCTGAAGGGCGAGATCAAGCAGAGG

CTGAAGCTGAAGGACGGCGGCCACTACGACGCTGAGGTCAAGACCACCTACAAGGCCAAGAAG

CCCGTGCAGCTGCCCGGCGCCTACAACGTCAACATCAAGTTGGACATCACCTCCCACAACGAGG

ACTACACCATCGTGGAACAGTACGAACGCGCCGAGGGCCGCCACTCCACCGGCGGCATGGACG

TABLE 2-continued

| Exemplary nucleotide sequences for the open reading frames of the recombinant MVAΔE5R constructs of the present technology. |
|---|
| AGCTGTACAAGTAATGAAGTTCCTATACTTTCTAGAGAATAGGAACTTCCGGTTCACTCGACGA |
| ACTAAACTACCTATACAAGATATGGTTGTGCCATAATTTTTATAAATTTTTTTATGAGTATTTTT |
| ACAAAAATGTATAAAGTGTATGTCTTATGTATATTTATAAAAATGCTAAATATGCGATGTATCTA |
| TGTTATTTGTATTTATCTAAACAATACCTCTACCTCTAGATATTATACAAAAATTTTTTATTTCGG |
| CATATTAAAGTAAAATCTAGTTACCTTGAAAATGAATACAGTGGGTGGTTCCGTATCACCAGTA |
| AGAACATAATAGTCGAATACAGTATCCGATTGAGATTTTGCATACAATACTAGTCTAGAAAGAA |
| ATTTGTAATCATCTTCTGTGACGGGAGTCCATATATCTGTATCATCGTCCCATGCTATATTCCTGT |
| TATCATCATTAGTTAATGAAAATAACTCTCGTGCTTCAGAAAAGTCAAATATTGTATCCATACAT |
| ACATCTCCAAAACTATCGCTTATACGTTTATCTTTAACGATACCTATACCTAGATGGTTATTTAC |
| TAACAGACATTTTCCAGATCTATTGACTATAACTCCTATAGTTTCCACATCAACCAAGTAATGAT |
| CATCTATTGTTATATAACAATAACATAACTCTTTTCCGTTTTTATCAGTATGTATATCTATATCAA |
| CGTCGTCGTTGTAGTGAGCTCCTTTTCACGTAGAAAGCCAGTCCGCAGAAACGGTGCTGACCCC |
| GGATGAATGTCAGCTACTGGGCTATCTGGACAAGGGAAAACGCAAGCGCAAAGAGAAAGCAGG |
| TAGCTTGCAGTGGGCTTACATGGCGATAGCTAGACTGGGCGGTTTTATGGACAGCAAGCGAACC |
| GGAATTGCCAGCTGGGGCGCCCTCTGGTAAGGTTGGGAAGCCCTGCAAAGTAAACTGGATGGCT |
| TTCTCGCCGCCAAGGATCTGATGGCGCAGGGGATCAAGCTCTGATCAAGAGACAGGATGAGGA |
| TCGTTTCGCATGATTGAACAAGATGGATTGCACGCAGGTTCTCCGGCCGCTTGGGTGGAGAGGC |
| TATTCGGCTATGACTGGGCACAACAGACAATCGGCTGCTCTGATGCCGCCGTGTTCCGGCTGTC |
| AGCGCAGGGGCGCCCGGTTCTTTTTGTCAAGACCGACCTGTCCGGTGCCCTGAATGAACTGCAA |
| GACGAGGCAGCGCGGCTATCGTGGCTGGCCACGACGGGCGTTCCTTGCGCAGCTGTGCTCGACG |
| TTGTCACTGAAGCGGGAAGGGACTGGCTGCTATTGGGCGAAGTGCCGGGGCAGGATCTCCTGTC |
| ATCTCACCTTGCTCCTGCCGAGAAAGTATCCATCATGGCTGATGCAATGCGGCGGCTGCATACG |
| CTTGATCCGGCTACCTGCCCATTCGACCACCAAGCGAAACATCGCATCGAGCGAGCACGTACTC |
| GGATGGAAGCCGGTCTTGTCGATCAGGATGATCTGGACGAAGAGCATCAGGGGCTCGCGCCAG |
| CCGAACTGTTCGCCAGGCTCAAGGCGAGCATGCCCGACGGCGAGGATCTCGTCGTGACCCATGG |
| CGATGCCTGCTTGCCGAATATCATGGTGGAAAATGGCCGCTTTTCTGGATTCATCGACTGTGGCC |
| GGCTGGGTGTGGCGGACCGCTATCAGGACATAGCGTTGGCTACCCGTGATATTGCTGAAGAGCT |
| TGGCGGCGAATGGGCTGACCGCTTCCTCGTGCTTTACGGTATCGCCGCTCCCGATTCGCAGCGC |
| ATCGCCTTCTATCGCCTTCTTGACGAGTTCTTCTGAATTATTAACGCTTACAATTTCCTGATGCGG |
| TATTTTCTCCTTACGCATCTGTGCGGTATTTCACACCGCATACAGGTGGCACTTTTCGGGGAAAT |
| GTGCGCGGAACCCCTATTTTCGTTCCACTGAGCGTCAGACCCCGTAGAAAAGATCAAAGGATCT |
| TCTTGAGATCCTTTTTTTCTGCGCGTAATCTGCTGCTTGCAAACAAAAAAACCACCGCTACCAGC |
| GGTGGTTTGTTTGCCGGATCAAGAGCTACCAACTCTTTTTCCGAAGGTAACTGGCTTCAGCAGA |
| GCGCAGATACCAAATACTGTCCTTCTAGTGTAGCCGTAGTTAGGCCACCACTTCAAGAACTCTG |
| TAGCACCGCCTACATACCTCGCTCTGCTAATCCTGTTACCAGTGGCTGCTGCCAGTGGCGATAA |
| GTCGTGTCTTACCGGGTTGGACTCAAGACGATAGTTACCGGATAAGGCGCAGCGGTCGGGCTGA |
| ACGGGGGGTTCGTGCACACAGCCCAGCTTGGAGCGAACGACCTACACCGAACTGAGATACCTA |
| CAGCGTGAGCTATGAGAAAGCGCCACGCTTCCCGAAGGGAGAAAGGCGGACAGGTATCCGGTA |

TABLE 2-continued

| Exemplary nucleotide sequences for the open reading frames of the recombinant MVAΔE5R constructs of the present technology. |
|---|
| AGCGGCAGGGTCGGAACAGGAGAGCGCACGAGGGAGCTTCCAGGGGGAAACGCCTGGTATCTT |
| TATAGTCCTGTCGGGTTTCGCCACCTCTGACTTGAGCGTCGATTTTTGTGATGCTCGTCAGGGGG |
| GCGGAGCCTATGGAAAAACGCCAGCAACGCGGCCTTTTTACGGTTCCTGGGCTTTTGCTGGCCT |
| TTTGCTCACATGTTCTTTCCTGCGTTATCCCCTGATTCTGTGGATAACCGTATTACCGCCTTTGAG |
| TGAGCTGATACCGCTCGCCGCAGCCGAACGACCGAGCGCAGCGAGTCA |

In some embodiments, engineered MVAΔE5R virus is generated by inserting an expression construct such as those illustrated by SEQ ID NOs: 22-24 and 32 (Table 2) into the MVA genomic region that corresponds to the position of the E5R locus (e.g., position 38,432 to 39,385 of SEQ ID NO: 1; or position 38,389 to 39,389 of the sequence set forth in GenBank Accession No. AY603355). In some embodiments, the MVAΔE5R virus is further engineered by inserting an expression construct such as that illustrated by SEQ ID NO: 31 into the MVA genomic region that corresponds to the E3L locus (e.g., position 36,931 to 37,497 of the sequence set forth in GenBank Accession No. AY603355). In some embodiments, the MVAΔE5R virus is further engineered by inserting an expression construct such as that illustrated by SEQ ID NO: 33 into the MVA genomic region that corresponds to the C11R locus (e.g., position 4,160-4,785 of the sequence set forth in GenBank Accession No. AY603355).

A non-limiting example of an MVAΔK7R construct open reading frame according to the present technology is shown in SEQ ID NO: 25 (Table 3).

TABLE 3

| Exemplary nucleotide sequence for the open reading frames of the recombinant MVAΔK7R construct of the present technology. | |
|---|---|
| pUC57-MVA-ΔK7R-mCherry vector nucleic acid sequence | (SEQ ID NO: 25) |
| 1 | TCGCGCGTTT CGGTGATGAC GGTGAAAACC TCTGACACAT GCAGCTCCCG GAGACGGTCA |
| 61 | CAGCTTGTCT GTAAGCGGAT GCCGGGAGCA GACAAGCCCG TCAGGGCGCG TCAGCGGGTG |
| 121 | TTGGCGGGTG TCGGGGCTGG CTTAACTATG CGGCATCAGA GCAGATTGTA CTGAGAGTGC |
| 181 | ACCATATGCG GTGTGAAATA CCGCACAGAT GCGTAAGGAG AAAATACCGC ATCAGGCGCC |
| 241 | ATTCGCCATT CAGGCTGCGC AACTGTTGGG AAGGGCGATC GGTGCGGGCC TCTTCGCTAT |
| 301 | TACGCCAGCT GGCGAAAGGG GGATGTGCTG CAAGGCGATT AAGTTGGGTA ACGCCAGGGT |
| 361 | TTTCCCAGTC ACGACGTTGT AAAACGACGG CCAGTGAATT Cttgctgtaa acaagtttgg |
| 421 | attatcgtaa gaggctagta tagaaattgt tgctcccatg gaatgaccca ataagtagat |
| 481 | ttaatagtta ccacgtgctg taccaaagtc atcaatcatc attttttcac cattacttct |
| 541 | tccatgtcca atatgatcat gtgagaatac taaaattcct aacgatgata tgttttcagc |
| 601 | tagttcgtca taacgtccag aatgtttacc agctccatga cttatgaata ctaatgcctt |
| 661 | aggatatgta atcattgtcc agattgaaca tacagtttgc actcatgatt cacgttatat |
| 721 | aactatcaat attaacagtt cgtttgatga tcatattatt tttatgtttt attgataatt |
| 781 | gtaaaaacat acaattaaat caatatagag gaaggagacg gctactgtct tttgtgagat |
| 841 | agtcgatatc tcactaattc caaacccacc cgctttttat agtaagtttt tcacccataa |
| 901 | ataataaata caataattaa tttctcgtaa aagtagaaaa tatattctaa tttattgcac |
| 961 | ggtaaggaag tagatcataa ctcgacatgg tgagcaaggg cgaggaggat aacatggcca |
| 1021 | tcatcaagga gttcatgcgc ttcaaggtgc acatggaggg ctccgtgaac ggccacgagt |
| 1081 | tcgagatcga gggcgagggc gagggccgcc cctacgaggg cacccagacc gccaagctga |
| 1141 | aggtgaccaa gggtggcccc ctgcccttcg cctgggacat cctgtcccct cagttcatgt |
| 1201 | acggctccaa ggcctacgtg aagcaccccg ccgacatccc cgactacttg aagctgtcct |
| 1261 | tccccgaggg cttcaagtgg gagcgcgtga tgaacttcga ggacggcggc gtggtgaccg |

TABLE 3-continued

| Exemplary nucleotide sequence for the open reading frames of the recombinant MVAΔK7R construct of the present technology. |
|---|
| 1321 tgacccagga ctcctccctg caggacggcg agttcatcta caaggtgaag ctgcgcggca |
| 1381 ccaacttccc ctccgacggc cccgtaatgc agaagaagac catgggctgg gaggcctcct |
| 1441 ccgagcggat gtaccccgag gacggcgccc tgaagggcga gatcaagcag aggctgaagc |
| 1501 tgaaggacgg cggccactac gacgctgagg tcaagaccac ctacaaggcc aagaagcccg |
| 1561 tgcagctgcc cggcgcctac aacgtcaaca tcaagttgga catcacctcc cacaacgagg |
| 1621 actacaccat cgtggaacag tacgaacgcg ccgagggccg ccactccacc ggcggcatgg |
| 1681 acgagctGAT CACGAATTgt taactgatat aggggtcttc ataacgcata attattacgt |
| 1741 tagcattcta tatccgtgtt aaaaaaaatt atcctatcat gtatttgaga gttttatatg |
| 1801 tagcaaacat gatagctgtg atgccaataa gctttagata ttcacgcgtg ctagtgttag |
| 1861 ggatggtatt atctggtggt gaaatgtccg ttatataatc tacaaaacaa tcatcgcata |
| 1921 tagtatgcga tagtagagta aacattttta tagtttttac tggattcata catcgtctac |
| 1981 ccaattcggt tatgaatgaa attgtcgcca atcttacacc caaccccttg ttatccatta |
| 2041 gtatagtatt aacttcgtta tttatgtcat aaactgtaaa tgattttgta gatgccatat |
| 2101 catacatgat attcatgtcc ctattataat cAAGCTTGGC GTAATCATGG TCATAGCTGT |
| 2161 TTCCTGTGTG AAATTGTTAT CCGCTCACAA TTCCACACAA CATACGAGCC GGAAGCATAA |
| 2221 AGTGTAAAGC CTGGGGTGCC TAATGAGTGA GCTAACTCAC ATTAATTGCG TTGCGCTCAC |
| 2281 TGCCCGCTTT CCAGTCGGGA AACCTGTCGT GCCAGCTGCA TTAATGAATC GGCCAACGCG |
| 2341 CGGGGAGAGG CGGTTTGCGT ATTGGGCGCT CTTCCGCTTC CTCGCTCACT GACTCGCTGC |
| 2401 GCTCGGTCGT TCGGCTGCGG CGAGCGGTAT CAGCTCACTC AAAGGCGGTA ATACGGTTAT |
| 2461 CCACAGAATC AGGGGATAAC GCAGGAAAGA ACATGTGAGC AAAAGGCCAG CAAAAGGCCA |
| 2521 GGAACCGTAA AAAGGCCGCG TTGCTGGCGT TTTTCCATAG GCTCCGCCCC CCTGACGAGC |
| 2581 ATCACAAAAA TCGACGCTCA AGTCAGAGGT GGCGAAACCC GACAGGACTA TAAAGATACC |
| 2641 AGGCGTTTCC CCCTGGAAGC TCCCTCGTGC GCTCTCCTGT TCCGACCCTG CCGCTTACCG |
| 2701 GATACCTGTC CGCCTTTCTC CCTTCGGGAA GCGTGGCGCT TTCTCATAGC TCACGCTGTA |
| 2761 GGTATCTCAG TTCGGTGTAG GTCGTTCGCT CCAAGCTGGG CTGTGTGCAC GAACCCCCCG |
| 2821 TTCAGCCCGA CCGCTGCGCC TTATCCGGTA ACTATCGTCT TGAGTCCAAC CCGGTAAGAC |
| 2881 ACGACTTATC GCCACTGGCA GCAGCCACTG GTAACAGGAT TAGCAGAGCG AGGTATGTAG |
| 2941 GCGGTGCTAC AGAGTTCTTG AAGTGGTGGC CTAACTACGG CTACACTAGA AGAACAGTAT |
| 3001 TTGGTATCTG CGCTCTGCTG AAGCCAGTTA CCTTCGGAAA AAGAGTTGGT AGCTCTTGAT |
| 3061 CCGGCAAACA AACCACCGCT GGTAGCGGTG GTTTTTTTGT TTGCAAGCAG CAGATTACGC |
| 3121 GCAGAAAAAA AGGATCTCAA GAAGATCCTT TGATCTTTTC TACGGGGTCT GACGCTCAGT |
| 3181 GGAACGAAAA CTCACGTTAA GGGATTTTGG TCATGAGATT ATCAAAAAGG ATCTTCACCT |
| 3241 AGATCCTTTT AAATTAAAAA TGAAGTTTTA AATCAATCTA AAGTATATAT GAGTAAACTT |
| 3301 GGTCTGACAG TTACCAATGC TTAATCAGTG AGGCACCTAT CTCAGCGATC TGTCTATTTC |
| 3361 GTTCATCCAT AGTTGCCTGA CTCCCCGTCG TGTAGATAAC TACGATACGG GAGGGCTTAC |
| 3421 CATCTGGCCC CAGTGCTGCA ATGATACCGC GAGACCCACG CTCACCGGCT CCAGATTTAT |
| 3481 CAGCAATAAA CCAGCCAGCC GGAAGGGCCG AGCGCAGAAG TGGTCCTGCA ACTTTATCCG |
| 3541 CCTCCATCCA GTCTATTAAT TGTTGCCGGG AAGCTAGAGT AAGTAGTTCG CCAGTTAATA |
| 3601 GTTTGCGCAA CGTTGTTGCC ATTGCTACAG GCATCGTGGT GTCACGCTCG TCGTTTGGTA |

TABLE 3-continued

| Exemplary nucleotide sequence for the open reading frames of the recombinant MVAΔK7R construct of the present technology. |
|---|
| 3661 TGGCTTCATT CAGCTCCGGT TCCCAACGAT CAAGGCGAGT TACATGATCC CCCATGTTGT |
| 3721 GCAAAAAAGC GGTTAGCTCC TTCGGTCCTC CGATCGTTGT CAGAAGTAAG TTGGCCGCAG |
| 3781 TGTTATCACT CATGGTTATG GCAGCACTGC ATAATTCTCT TACTGTCATG CCATCCGTAA |
| 3841 GATGCTTTTC TGTGACTGGT GAGTACTCAA CCAAGTCATT CTGAGAATAG TGTATGCGGC |
| 3901 GACCGAGTTG CTCTTGCCCG GCGTCAATAC GGGATAATAC CGCGCCACAT AGCAGAACTT |
| 3961 TAAAAGTGCT CATCATTGGA AAACGTTCTT CGGGGCGAAA ACTCTCAAGG ATCTTACCGC |
| 4021 TGTTGAGATC CAGTTCGATG TAACCCACTC GTGCACCCAA CTGATCTTCA GCATCTTTTA |
| 4081 CTTTCACCAG CGTTTCTGGG TGAGCAAAAA CAGGAAGGCA AAATGCCGCA AAAAAGGGAA |
| 4141 TAAGGGCGAC ACGGAAATGT TGAATACTCA TACTCTTCCT TTTTCAATAT TATTGAAGCA |
| 4201 TTTATCAGGG TTATTGTCTC ATGAGCGGAT ACATATTTGA ATGTATTTAG AAAAATAAAC |
| 4261 AAATAGGGGT TCCGCGCACA TTTCCCCGAA AAGTGCCACC TGACGTCTAA GAAACCATTA |
| 4321 TTATCATGAC ATTAACCTAT AAAAATAGGC GTATCACGAG GCCCTTTCGT C |

VACVΔC7L

The disclosure of the present technology relates to a C7L mutant vaccinia virus (i.e., VACVΔC7L; VACV comprising a C7L deletion; VACV genetically engineered to comprise a mutant C7L gene), or immunogenic compositions comprising the virus, in which the virus is engineered to express one or more specific genes of interest (SG), such as OX40L, and its use as a cancer immunotherapeutic (VACVΔC7L-OX40L). In some embodiments, the C7 gene of the vaccinia virus, through homologous recombination techniques, is engineered to contain a disruption comprising a heterologous nucleic acid sequence comprising one or more expression cassettes, which result in a C7 knockout such that the C7 gene is not expressed, expressed at levels so low as to have no effect, or the expressed protein is non-functional (e.g., is a null-mutation). In some embodiments, the ΔC7L mutant includes a heterologous nucleic acid sequence in place of all or a majority of the C7L gene sequence. For example, in some embodiments, the nucleic acid sequence corresponding to the position of C7 in the VACV genome (e.g., position 15,716 to 16,168 of SEQ ID NO: 2) is replaced with a heterologous nucleic acid sequence comprising an open reading frame that encodes a specific gene of interest (SG), such as human OX40L, resulting in VACVΔC7L-OX40L. In some embodiments, the expression cassette comprises a single open reading frame that encodes hFlt3L, resulting in VACVΔC7L-hFlt3L.

Additionally or alternatively, in some embodiments, VACVΔC7L is engineered to express both OX40L and hFlt3L. In some embodiments, the thymidine kinase (TK) gene of the vaccinia virus (e.g., position 80,962 to 81,032 of SEQ ID NO: 2), through homologous recombination, is engineered to contain a disruption comprising a heterologous nucleic acid sequence comprising one or more expression cassettes, which results in a TK gene knockout such that the TK gene is not expressed, expressed at levels so low as to have no effect, or the expressed protein is non-functional (e.g., is a null-mutation). The resulting VACVΔC7L-TK(−) virus is further engineered to comprise one or more expression cassettes that are flanked by a partial sequence of the TK gene (TK-L and TK-R) on either side. In some embodiments, the expression cassette comprises a single open reading frame that encodes a specific gene of interest (SG), such as OX40L using the vaccinia viral synthetic early and late promoter (PsE/L), resulting in VACVΔC7L-TK(−)-OX40L. In some embodiments, the recombinant virus is further modified at the C7 locus, through homologous recombination techniques, to contain a disruption comprising a heterologous nucleic acid sequence comprising one or more expression cassettes, which result in a C7 knockout such that the C7 gene is not expressed, expressed at levels so low as to have no effect, or the expressed protein is non-functional (e.g., is a null-mutation). In some embodiments, the expression cassette comprises a single open reading frame that encodes a specific gene of interest (SG), such as hFlt3L, resulting in VACVΔC7L-hFlt3L-TK(−)-OX40L. In some embodiments, the expression cassette encoding OX40L is inserted into the C7 locus while the expression cassette encoding hFlt3L is inserted into the TK locus. In some embodiments, a VACVΔC7L-anti-CTLA-4-hFlt3L-TK(−) virus is further modified to encode OX40L, resulting in VACVΔC7L-anti-CTLA-4-TK(−)-hFlt3L-OX40L. In some embodiments, the VACVΔC7L-anti-CTLA-4-TK(−)-hFlt3L-OX40L virus is further modified to express hIL-12, resulting in VACVΔC7L-anti-CTLA-4-TK(−)-hFlt3L-OX40L-hIL-12.

Additionally or alternatively, in some embodiments, the heterologous nucleic acid sequence comprises an expression cassette comprising two or more open reading frames encoding two or more specific genes of interest, separated by a nucleotide sequence that encodes, in the 5' to 3' direction, a protease cleavage site (e.g., a furin cleavage site) and a 2A peptide (Pep2A) sequence.

In some embodiments, the disclosure of the present technology provides a VACVΔC7L-TK(−)-anti-CTLA-4-OX40L virus. In some embodiments, the disclosure of the present technology provides a VACVΔC7L-E3LΔ83N-TK(−)-hFlt3L-anti-CTLA-4-OX40L virus.

In some embodiments, the recombinant VACVΔC7L-OX40L viruses described above are modified to express at least one further heterologous gene, such as any one or more of hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one other viral gene mutation or deletion, such as any one or more of the following deletions: E3L (ΔE3L); E3LΔ83N; B2R (ΔB2R), B19R (B18R; ΔWR200); E5R; K7R; C12L (IL18BP); B8R; B14R; N1L; C11R; K1L; M1L; N2L; and/or WR199. In other embodiments, no further heterologous genes are added other than those provided in the name of the virus herein (e.g., OX40L or OX40L and hFlt3L), and/or no further viral genes other than C7L or C7L and TK are disrupted or deleted.

Although in certain embodiments described above, the transgene may be inserted into the TK locus, splitting the TK gene and obliterating it, other suitable integration loci can be selected. For example, VACV encodes several immune modulatory genes, including but not limited to C11, K3, F1, F2, F4, F6, F8, F9, F11, F14.5, J2, A46, E3L, B18R (WR200), E5R, K7R, C12L, B8R, B14R, N1L, C11R, K1L, C16, M1L, N2L, and WR199. Accordingly, in some embodiments, these genes can be deleted to potentially enhance immune activating properties of the virus and allow insertion of transgenes.

In some embodiments, the heterologous nucleotide sequence further comprises an additional expression cassette comprising an open reading frame that encodes a selectable marker operably linked to a promoter that is capable of directing expression of the selectable marker. In some embodiments, the selectable marker is a xanthine-guanine phosphoribosyl transferase (gpt) gene. In some embodiments, the selectable marker is a green fluorescent protein (GFP) gene. In some embodiments, the selectable marker is an mCherry gene encoding a red fluorescent protein.

VACVΔE5R

The disclosure of the present technology relates to a E5R mutant vaccinia virus (i.e., VACVΔE5R; VACV comprising an E5R deletion; VACV genetically engineered to comprise a mutant E5R gene), or immunogenic compositions comprising the virus, in which the virus is engineered to express one or more specific genes of interest (SG), such as OX40L, and its use as a cancer immunotherapeutic (VACVΔE5R-OX40L). In some embodiments, the E5R gene of the vaccinia virus, through homologous recombination techniques, is engineered to contain a disruption comprising a heterologous nucleic acid sequence comprising one or more expression cassettes, which result in an E5R knockout such that the E5R gene is not expressed, expressed at levels so low as to have no effect, or the expressed protein is non-functional (e.g., is a null-mutation). In some embodiments, the ΔE5R mutant includes a heterologous nucleic acid sequence in place of all or a majority of the E5R gene sequence. For example, in some embodiments, the nucleic acid sequence corresponding to the position of E5R in the VACV genome (e.g., position 49,236 to 50,261 of SEQ ID NO: 2) is replaced with a heterologous nucleic acid sequence comprising an open reading frame that encodes a specific gene of interest (SG), such as human OX40L, resulting in VACVΔE5R-OX40L. In some embodiments, the expression cassette comprises a single open reading frame that encodes hFlt3L, resulting in VACVΔE5R-hFlt3L.

Additionally or alternatively, in some embodiments, VACVΔE5R is engineered to express both OX40L and hFlt3L. In some embodiments, the thymidine kinase (TK) gene of the vaccinia virus (e.g., position 80,962 to 81,032 of SEQ ID NO: 2), through homologous recombination, is engineered to contain a disruption comprising a heterologous nucleic acid sequence comprising one or more expression cassettes, which results in a TK gene knockout such that the TK gene is not expressed, expressed at levels so low as to have no effect, or the expressed protein is non-functional (e.g., is a null-mutation). The resulting VACVΔE5R-TK(−) virus is further engineered to comprise one or more expression cassettes that are flanked by a partial sequence of the TK gene (TK-L and TK-R) on either side. In some embodiments, the expression cassette comprises a single open reading frame that encodes a specific gene of interest (SG), such as OX40L using the vaccinia viral synthetic early and late promoter (PsE/L), resulting in VACVΔE5R-TK(−)-OX40L. In some embodiments, the recombinant virus is further modified at the E5R locus, through homologous recombination techniques, to contain a disruption comprising a heterologous nucleic acid sequence comprising one or more expression cassettes, which result in an E5R knockout such that the E5R gene is not expressed, expressed at levels so low as to have no effect, or the expressed protein is non-functional (e.g., is a null-mutation). In some embodiments, the expression cassette comprises a single open reading frame that encodes a specific gene of interest (SG), such as hFlt3L, resulting in VACVΔE5R-hFlt3L-TK(−)-OX40L. In some embodiments, the expression cassette encoding OX40L is inserted into the E5R locus while the expression cassette encoding hFlt3L is inserted into the TK locus. In some embodiments, a VACVΔE5R-anti-CTLA-4-hFlt3L-TK(−) virus is further modified to encode OX40L, resulting in VACVΔE5R-anti-CTLA-4-TK(−)-hFlt3L-OX40L. In some embodiments, the VACVΔE5R-anti-CTLA-4-TK(−)-hFlt3L-OX40L virus is further modified to express hIL-12, resulting in VACVΔE5R-anti-CTLA-4-TK(−)-hFlt3L-OX40L-hIL-12. In some embodiments, the VACVΔE5R is engineered to comprise a nucleic acid encoding IL-15/IL-15Rα (VACVΔE5R-IL-15/IL-15Rα) alone or in combination with one or more additional modifications as described herein. For example, in some embodiments, the VACVΔE5R-IL-15/IL-15Rα is further engineered to comprise a nucleic acid encoding OX40L (VACVΔE5R-IL-15/IL-15Rα-OX40L).

Additionally or alternatively, in some embodiments, the heterologous nucleic acid sequence comprises an expression cassette comprising two or more open reading frames encoding two or more specific genes of interest, separated by a nucleotide sequence that encodes, in the 5' to 3' direction, a protease cleavage site (e.g., a furin cleavage site) and a 2A peptide (Pep2A) sequence. For example, in some embodiments, the TK locus of the vaccinia genome is modified through homologous recombination to express both the heavy and light chain of an antibody, such as anti-CTLA-4, wherein the coding sequences of the heavy chain and light chain are separated by a cassette including a furin cleavage site followed by a 2A peptide (Pep2A) sequence to produce VACV-TK(−)-anti-CTLA-4. In some embodiments, the VACV-TK(−)-anti-CTLA-4 genome is further modified to comprise a deletion of E5R, in which all or a majority of the E5R gene sequence is replaced by a first specific gene of interest (e.g., hFlt3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as VACV-TK$^-$-anti-CTLA-4-E5R$^-$-hFlt3L-OX40L (or VACVΔE5R-TK(−)-anti-CTLA-4-hFlt3L-OX40L) (see, e.g., FIG. 85A).

In some embodiments, the genetically engineered or recombinant VACVΔE5R viruses described above are modified to express at least one heterologous gene, such as any one or more of hOX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one other viral gene mutation or deletion, such as any one or more of the following deletions: E3L (ΔE3L); E3LΔ83N; C7 (ΔC7L); B2R (ΔB2R), B19R (B18R; ΔWR200); E5R; K7R; C12L (IL18BP); B8R; B14R; N1L; C11R; K1L; M1L; N2L; and/or WR199. In other embodiments, no further heterologous genes are added other than those provided in the name of the virus herein (e.g., OX40L or OX40L and hFlt3L), and/or no further viral genes other than E5R or E5R and TK are disrupted or deleted.

Although in certain embodiments described above, the transgene may be inserted into the TK locus, splitting the TK gene and obliterating it, other suitable integration loci can be selected. For example, VACV encodes several immune modulatory genes, including but not limited to C7, C11, K3, F1, F2, F4, F6, F8, F9, F11, F14.5, J2, A46, E3L, B18R (WR200), E5R, K7R, C12L, B8R, B14R, N1L, C11R, K1L, C16, M1L, N2L, and WR199. Accordingly, in some embodiments, these genes can be deleted to potentially enhance immune activating properties of the virus and allow insertion of transgenes.

In other embodiments, no further heterologous genes are added other than those provided in the name of the virus herein (e.g., OX40L), and/or no further viral genes other than E5R or E5R and TK are disrupted or deleted.

In some embodiments, the heterologous nucleotide sequence further comprises an additional expression cassette comprising an open reading frame that encodes a selectable marker operably linked to a promoter that is capable of directing expression of the selectable marker. In some embodiments, the selectable marker is a xanthine-guanine phosphoribosyl transferase (gpt) gene. In some embodiments, the selectable marker is a green fluorescent protein (GFP) gene. In some embodiments, the selectable marker is an mCherry gene encoding a red fluorescent protein.

Non-limiting examples of VACVΔE5R construct open reading frames according to the present technology are shown in SEQ ID NOs: 26-28 (Table 4).

TABLE 4

Exemplary nucleotide sequences for the open reading frames of the recombinant VACVΔE5R constructs of the present technology.

pUC57-VACV-ΔE5R-mCherry vector nucleic acid sequence (SEQ ID NO: 26)

```
   1 TCGCGCGTTT CGGTGATGAC GGTGAAAACC TCTGACACAT GCAGCTCCCG GAGACGGTCA

  61 CAGCTTGTCT GTAAGCGGAT GCCGGGAGCA GACAAGCCCG TCAGGGCGCG TCAGCGGGTG

 121 TTGGCGGGTG TCGGGGCTGG CTTAACTATG CGGCATCAGA GCAGATTGTA CTGAGAGTGC

 181 ACCATATGCG GTGTGAAATA CCGCACAGAT GCGTAAGGAG AAAATACCGC ATCAGGCGCC

 241 ATTCGCCATT CAGGCTGCGC AACTGTTGGG AAGGGCGATC GGTGCGGGCC TCTTCGCTAT

 301 TACGCCAGCT GGCGAAAGGG GGATGTGCTG CAAGGCGATT AAGTTGGGTA ACGCCAGGGT

 361 TTTCCCAGTC ACGACGTTGT AAAACGACGG CCAGTGAATT CGAGCTCGGT ACCgagatag

 421 cgaaggaatt ctttttcggt gccgctagta cccttaatca tatcacatag tgttttatat

 481 tccaaatttg tggcaataga cggtttattt ctatacgata gtttgtttct ggaatccttt

 541 gagtattcta taccaatatt attctttgat tcgaatttag tttcttcgat attagatttt

 601 gtattaccta tattcttgat gtagtacttt gatgattttt ccatggccca ttctattaag

 661 tcttccaagt tggcatcatc cacatattgt gatagtaatt ctcggatatc agtagcggtt

 721 accgccattg atgtttgttc attggatgag taactactaa tgtatacatt ttccatttat

 781 aacacttatg tattaacttt gttcatttat atttttttcat tattaagctt gatcaggcct

 841 tcactaattc caaacccacc cgctttttat agtaagtttt tcacccataa ataataaata

 901 caataattaa tttctcgtaa aagtagaaaa tatattctaa tttattgcac ggtaaggaag

 961 tagatcataa ctcgacatgg tgagcaaggg cgaggaggat aacatggcca tcatcaagga

1021 gttcatgcgc ttcaaggtgc acatggaggg ctccgtgaac ggccacgagt tcgagatcga

1081 gggcgagggc gagggccgcc cctacgaggg cacccagacc gccaagctga aggtgaccaa

1141 gggtggcccc ctgcccttcg cctgggacat cctgtcccct cagttcatgt acggctccaa

1201 ggcctacgtg aagcaccccg ccgacatccc cgactacttg aagctgtcct tccccgaggg

1261 cttcaagtgg gagcgcgtga tgaacttcga ggacggcggc gtggtgaccg tgacccagga

1321 ctcctccctg caggacggcg agttcatcta caaggtgaag ctgcgcggca ccaacttccc

1381 ctccgacggc cccgtaatgc agaagaagac catgggctgg gaggcctcct ccgagcggat

1441 gtaccccgag gacggcgccc tgaagggcga gatcaagcag aggctgaagc tgaaggacgg
```

TABLE 4-continued

| Exemplary nucleotide sequences for the open reading frames of the recombinant VACVΔE5R constructs of the present technology. |
|---|
| 1501 cggccactac gacgctgagg tcaagaccac ctacaaggcc aagaagcccg tgcagctgcc |
| 1561 cggcgcctac aacgtcaaca tcaagttgga catcacctcc cacaacgagg actacaccat |
| 1621 cgtggaacag tacgaacgcg ccgagggccg ccactccacc ggcggcatgg acgagctGAT |
| 1681 CACGAATTgt taacctgcat ttcatctttc tccaatacta attcaaattg ttaaattaat |
| 1741 aatggatagt ataaatagtt attagtgata aaatagtaaa aataattatt agaataagag |
| 1801 tgtagtatca tagataactc tcttctataa aaatggattt tattcgtaga aagtatctta |
| 1861 tatacacagt agaaaataat atagattttt taaaggatga tacattaagt aaagtaaaca |
| 1921 attttaccct caatcatgta ctagctctca agtatctagt tagcaatttt cctcaacatg |
| 1981 ttattactaa ggatgtatta gctaatacca atttttttgt tttcatacat atggtacgat |
| 2041 gttgtaaagt gtacgaagcg gttttacgac acgcatttga tgcacccacg ttgtacgtta |
| 2101 aagcattgac taagaattat tGGATCCCGG GCCCGTCGAC TGCAGAGGCC TGCATGCAAG |
| 2161 CTTGGCGTAA TCATGGTCAT AGCTGTTTCC TGTGTGAAAT TGTTATCCGC TCACAATTCC |
| 2221 ACACAACATA CGAGCCGGAA GCATAAAGTG TAAAGCCTGG GGTGCCTAAT GAGTGAGCTA |
| 2281 ACTCACATTA ATTGCGTTGC GCTCACTGCC CGCTTTCCAG TCGGGAAACC TGTCGTGCCA |
| 2341 GCTGCATTAA TGAATCGGCC AACGCGCGGG GAGAGGCGGT TTGCGTATTG GGCGCTCTTC |
| 2401 CGCTTCCTCG CTCACTGACT CGCTGCGCTC GGTCGTTCGG CTGCGGCGAG CGGTATCAGC |
| 2461 TCACTCAAAG GCGGTAATAC GGTTATCCAC AGAATCAGGG GATAACGCAG GAAAGAACAT |
| 2521 GTGAGCAAAA GGCCAGCAAA AGGCCAGGAA CCGTAAAAAG GCCGCGTTGC TGGCGTTTTT |
| 2581 CCATAGGCTC CGCCCCCCTG ACGAGCATCA CAAAAATCGA CGCTCAAGTC AGAGGTGGCG |
| 2641 AAACCCGACA GGACTATAAA GATACCAGGC GTTTCCCCCT GGAAGCTCCC TCGTGCGCTC |
| 2701 TCCTGTTCCG ACCCTGCCGC TTACCGGATA CCTGTCCGCC TTTCTCCCTT CGGGAAGCGT |
| 2761 GGCGCTTTCT CATAGCTCAC GCTGTAGGTA TCTCAGTTCG GTGTAGGTCG TTCGCTCCAA |
| 2821 GCTGGGCTGT GTGCACGAAC CCCCCGTTCA GCCCGACCGC TGCGCCTTAT CCGGTAACTA |
| 2881 TCGTCTTGAG TCCAACCCGG TAAGACACGA CTTATCGCCA CTGGCAGCAG CCACTGGTAA |
| 2941 CAGGATTAGC AGAGCGAGGT ATGTAGGCGG TGCTACAGAG TTCTTGAAGT GGTGGCCTAA |
| 3001 CTACGGCTAC ACTAGAAGAA CAGTATTTGG TATCTGCGCT CTGCTGAAGC CAGTTACCTT |
| 3061 CGGAAAAAGA GTTGGTAGCT CTTGATCCGG CAAACAAACC ACCGCTGGTA GCGGTGGTTT |
| 3121 TTTTGTTTGC AAGCAGCAGA TTACGCGCAG AAAAAAAGGA TCTCAAGAAG ATCCTTTGAT |
| 3181 CTTTTCTACG GGGTCTGACG CTCAGTGGAA CGAAAACTCA CGTTAAGGGA TTTTGGTCAT |
| 3241 GAGATTATCA AAAAGGATCT TCACCTAGAT CCTTTTAAAT TAAAAATGAA GTTTTAAATC |
| 3301 AATCTAAAGT ATATATGAGT AAACTTGGTC TGACAGTTAC CAATGCTTAA TCAGTGAGGC |
| 3361 ACCTATCTCA GCGATCTGTC TATTTCGTTC ATCCATAGTT GCCTGACTCC CCGTCGTGTA |
| 3421 GATAACTACG ATACGGGAGG GCTTACCATC TGGCCCCAGT GCTGCAATGA TACCGCGAGA |
| 3481 CCCACGCTCA CCGGCTCCAG ATTTATCAGC AATAAACCAG CCAGCCGGAA GGGCCGAGCG |
| 3541 CAGAAGTGGT CCTGCAACTT TATCCGCCTC CATCCAGTCT ATTAATTGTT GCCGGGAAGC |
| 3601 TAGAGTAAGT AGTTCGCCAG TTAATAGTTT GCGCAACGTT GTTGCCATTG CTACAGGCAT |
| 3661 CGTGGTGTCA CGCTCGTCGT TTGGTATGGC TTCATTCAGC TCCGGTTCCC AACGATCAAG |
| 3721 GCGAGTTACA TGATCCCCCA TGTTGTGCAA AAAAGCGGTT AGCTCCTTCG GTCCTCCGAT |

TABLE 4-continued

Exemplary nucleotide sequences for the open reading frames of the recombinant VACVΔE5R constructs of the present technology.

3781 CGTTGTCAGA AGTAAGTTGG CCGCAGTGTT ATCACTCATG GTTATGGCAG CACTGCATAA

3841 TTCTCTTACT GTCATGCCAT CCGTAAGATG CTTTTCTGTG ACTGGTGAGT ACTCAACCAA

3901 GTCATTCTGA GAATAGTGTA TGCGGCGACC GAGTTGCTCT TGCCCGGCGT CAATACGGGA

3961 TAATACCGCG CCACATAGCA GAACTTTAAA AGTGCTCATC ATTGGAAAAC GTTCTTCGGG

4021 GCGAAAACTC TCAAGGATCT TACCGCTGTT GAGATCCAGT TCGATGTAAC CCACTCGTGC

4081 ACCCAACTGA TCTTCAGCAT CTTTTACTTT CACCAGCGTT TCTGGGTGAG CAAAAACAGG

4141 AAGGCAAAAT GCCGCAAAAA AGGGAATAAG GGCGACACGG AAATGTTGAA TACTCATACT

4201 CTTCCTTTTT CAATATTATT GAAGCATTTA TCAGGGTTAT TGTCTCATGA GCGGATACAT

4261 ATTTGAATGT ATTTAGAAAA ATAAACAAAT AGGGGTTCCG CGCACATTTC CCCGAAAAGT

4321 GCCACCTGAC GTCTAAGAAA CCATTATTAT CATGACATTA ACCTATAAAA ATAGGCGTAT

4381 CACGAGGCCC TTTCGTC pUC57-VACV-ΔE5R-hFlt3L-hOX40L vector nucleic acid sequence (SEQ ID NO: 27)

1 tcgcgcgttt cggtgatgac ggtgaaaacc tctgacacat gcagctcccg gagacggtca 61 cagcttgtct gtaagcggat gccgggagca gacaagcccg tcagggcgcg tcagcgggtg 121 ttggcgggtg tcggggctgg cttaactatg cggcatcaga gcagattgta ctgagagtgc 181 accatatgcg gtgtgaaata ccgcacagat gcgtaaggag aaaataccgc atcaggcgcc 241 attcgccatt caggctgcgc aactgttggg aagggcgatc ggtgcgggcc tcttcgctat 301 tacgccagct ggcgaaaggg ggatgtgctg caaggcgatt aagttgggta acgccagggt 361 tttcccagtc acgacgttgt aaaacgacgg ccagtgaatt cgagctcggt accgagatag 421 cgaaggaatt ctttttcggt gccgctagta cccttaatca tatcacatag tgttttatat 481 tccaaatttg tggcaataga cggtttattt ctatacgata gtttgtttct ggaatccttt 541 gagtattcta taccaatatt attctttgat tcgaatttag tttcttcgat attagatttt 601 gtattaccta tattcttgat gtagtacttt gatgattttt ccatggccca ttctattaag 661 tcttccaagt tggcatcatc cacatattgt gatagtaatt ctcggatatc agtagcggtt 721 accgccattg atgtttgttc attggatgag taactactaa tgtatacatt ttccatttat 781 aacacttatg tattaacttt gttcatttat attttttcat tattaagctt ggatccaaaa 841 attgaaattt tatttttttt ttttggaata taaataagct cgaagtcgac gaattcatga 901 cagtactagc tccagcttgg tccccgacaa cataccttct actactacta ttgctatcct 961 ccggactatc tggaacccag gattgctctt ttcagcactc tccgatctcg tctgatttcg 1021 cggttaagat cagagagcta tccgactact tgctacagga ttacccagta accgtcgcgt 1081 ccaacctaca agatgaagaa ctatgtggtg gactttggag actagtccta gcgcaaagat 1141 ggatggaaag acttaagacc gtagcgggat ctaagatgca gggactacta gaaagagtca 1201 acaccgagat ccacttcgtc acaaagtgtg cgtttcaacc accaccgtcc tgtctaagat 1261 tcgtccagac aaacatctcc agactactac aagaaacctc cgagcagcta gtagcgctaa 1321 aaccgtggat cacaagacag aacttctcga gatgtctaga gctacagtgt cagccggatt 1381 cttctacatt accaccacca tggtcaccaa gaccactaga agctacagct ccaactgctc 1441 cacaaccacc attgctactt ttgctattgc tacccgtcgg attgctacta ttagctgctg 1501 cttggtgtct acactggcag agaactagaa gaagaactcc aagaccggga gaacaagtac 1561 caccagtacc atctccacag gacctactac tagtcgagca cagaagaaga agaagatcgg TABLE 4-continued Exemplary nucleotide sequences for the open reading frames of the recombinant VACVΔE5R constructs of the present technology.

1621 gagcgaccaa cttctcgcta ttgaaacaag cgggagatgt cgaagaaaat ccgggaccaa
1681 tggaaagagt acagccgcta gaagaaaacg taggaaatgc ggctagaccg agattcgaga
1741 gaaacaagct actattggtc gcgtccgtca tccaaggact aggattgcta ttgtgcttca
1801 cctacatctg cctacacttc tccgcgctac aagtctctca tagatacccg agaatccagt
1861 ccatcaaggt ccagttcacc gagtacaaga aagagaaggg attcatccta acctcgcaga
1921 aagaggacga gatcatgaag gtccagaaca actccgtcat catcaactgc gacggattct
1981 acctaatctc cctaaaggga tacttctccc aagaagtcaa catctccttg cactaccaga
2041 aggatgagga accgctattc cagctaaaga aagtcagatc cgtcaactcc ctaatggtcg
2101 cctctctaac gtacaaggac aaggtctacc taaacgtcac caccgacaac acatccctag
2161 atgatttcca cgtaaacggt ggagagctaa tcctaatcca tcagaacccg ggagagttct
2221 gtgtattata agttaacctg catttcatct ttctccaata ctaattcaaa ttgttaaatt
2281 aataatggat agtataaata gttattagtg ataaaatagt aaaaataatt attagaataa
2341 gagtgtagta tcatagataa ctctcttcta taaaaatgga ttttattcgt agaaagtatc
2401 ttatatacac agtagaaaat aatatagatt ttttaaagga tgatacatta agtaaagtaa
2461 acaattttac cctcaatcat gtactagctc tcaagtatct agttagcaat tttcctcaac
2521 atgttattac taaggatgta ttagctaata ccaatttttt tgttttcata catatggtac
2581 gatgttgtaa agtgtacgaa gcggttttac gacacgcatt tgatgcaccc acgttgtacg
2641 ttaaagcatt gactaagaat tattggatcc cgggcccgtc gaccaagctt ggcgtaatca
2701 tggtcatagc tgtttcctgt gtgaaattgt tatccgctca caattccaca caacatacga
2761 gccggaagca taaagtgtaa agcctggggt gcctaatgag tgagctaact cacattaatt
2821 gcgttgcgct cactgcccgc tttccagtcg ggaaacctgt cgtgccagct gcattaatga
2881 atcggccaac gcgcggggag aggcggtttg cgtattgggc gctcttccgc ttcctcgctc
2941 actgactcgc tgcgctcggt cgttcggctg cggcgagcgg tatcagctca ctcaaaggcg
3001 gtaatacggt tatccacaga atcaggggat aacgcaggaa agaacatgtg agcaaaaggc
3061 cagcaaaagg ccaggaaccg taaaaaggcc gcgttgctgg cgtttttcca taggctccgc
3121 ccccctgacg agcatcacaa aaatcgacgc tcaagtcaga ggtggcgaaa cccgacagga
3181 ctataaagat accaggcgtt tccccctgga agctccctcg tgcgctctcc tgttccgacc
3241 ctgccgctta ccggatacct gtccgccttt ctcccttcgg gaagcgtggc gctttctcat
3301 agctcacgct gtaggtatct cagttcggtg taggtcgttc gctccaagct gggctgtgtg
3361 cacgaacccc ccgttcagcc cgaccgctgc gccttatccg gtaactatcg tcttgagtcc
3421 aacccggtaa gacacgactt atcgccactg gcagcagcca ctggtaacag gattagcaga
3481 gcgaggtatg taggcggtgc tacagagttc ttgaagtggt ggcctaacta cggctacact
3541 agaagaacag tatttggtat ctgcgctctg ctgaagccag ttaccttcgg aaaaagagtt
3601 ggtagctctt gatccggcaa acaaaccacc gctggtagcg gtggtttttt tgtttgcaag
3661 cagcagatta cgcgcagaaa aaaaggatct caagaagatc ctttgatctt ttctacgggg
3721 tctgacgctc agtggaacga aaactcacgt taagggattt tggtcatgag attatcaaaa
3781 aggatcttca cctagatcct tttaaattaa aaatgaagtt ttaaatcaat ctaaagtata
3841 tatgagtaaa cttggtctga cagttaccaa tgcttaatca gtgaggcacc tatctcagcg TABLE 4-continued

| Exemplary nucleotide sequences for the open reading frames of the recombinant VACVΔE5R constructs of the present technology. |
|---|
| 3901 atctgtctat ttcgttcatc catagttgcc tgactccccg tcgtgtagat aactacgata |
| 3961 cgggagggct taccatctgg ccccagtgct gcaatgatac cgcgagaccc acgctcaccg |
| 4021 gctccagatt tatcagcaat aaaccagcca gccggaaggg ccgagcgcag aagtggtcct |
| 4081 gcaactttat ccgcctccat ccagtctatt aattgttgcc gggaagctag agtaagtagt |
| 4141 tcgccagtta atagtttgcg caacgttgtt gccattgcta caggcatcgt ggtgtcacgc |
| 4201 tcgtcgtttg gtatggcttc attcagctcc ggttcccaac gatcaaggcg agttacatga |
| 4261 tcccccatgt tgtgcaaaaa agcggttagc tccttcggtc ctccgatcgt tgtcagaagt |
| 4321 aagttggccg cagtgttatc actcatggtt atggcagcac tgcataattc tcttactgtc |
| 4381 atgccatccg taagatgctt ttctgtgact ggtgagtact caaccaagtc attctgagaa |
| 4441 tagtgtatgc ggcgaccgag ttgctcttgc ccggcgtcaa tacgggataa taccgcgcca |
| 4501 catagcagaa ctttaaaagt gctcatcatt ggaaaacgtt cttcggggcg aaaactctca |
| 4561 aggatcttac cgctgttgag atccagttcg atgtaaccca ctcgtgcacc caactgatct |
| 4621 tcagcatctt ttactttcac cagcgtttct gggtgagcaa aaacaggaag gcaaaatgcc |
| 4681 gcaaaaaagg gaataagggc gacacggaaa tgttgaatac tcatactctt cctttttcaa |
| 4741 tattattgaa gcatttatca gggttattgt ctcatgagcg gatacatatt tgaatgtatt |
| 4801 tagaaaaata aacaaatagg ggttccgcgc acatttcccc gaaaagtgcc acctgacgtc |
| 4861 taagaaacca ttattatcat gacattaacc tataaaaata ggcgtatcac gaggcccttt |
| 4921 cgtc |
| pUC57-VACV-ΔE5R-hFlt3L-mOX40L vector nucleic acid sequence (SEQ ID NO: 28) |
| 1 tcgcgcgttt cggtgatgac ggtgaaaacc tctgacacat gcagctcccg gagacggtca |
| 61 cagcttgtct gtaagcggat gccgggagca gacaagcccg tcagggcgcg tcagcgggtg |
| 121 ttggcgggtg tcggggctgg cttaactatg cggcatcaga gcagattgta ctgagagtgc |
| 181 accatatgcg gtgtgaaata ccgcacagat gcgtaaggag aaaataccgc atcaggcgcc |
| 241 attcgccatt caggctgcgc aactgttggg aagggcgatc ggtgcgggcc tcttcgctat |
| 301 tacgccagct ggcgaaaggg ggatgtgctg caaggcgatt aagttgggta acgccagggt |
| 361 tttcccagtc acgacgttgt aaaacgacgg ccagtgaatt cgagctcggt accgagatag |
| 421 cgaaggaatt ctttttcggt gccgctagta cccttaatca tatcacatag tgttttatat |
| 481 tccaaatttg tggcaataga cggtttattt ctatacgata gtttgtttct ggaatccttt |
| 541 gagtattcta taccaatatt attctttgat tcgaatttag tttcttcgat attagatttt |
| 601 gtattaccta tattcttgat gtagtacttt gatgattttt ccatggccca ttctattaag |
| 661 tcttccaagt tggcatcatc cacatattgt gatagtaatt ctcggatatc agtagcggtt |
| 721 accgccattg atgtttgttc attggatgag taactactaa tgtatacatt ttccatttat |
| 781 aacacttatg tattaacttt gttcatttat attttttcat tattaagctt ggatccaaaa |
| 841 attgaaattt tattttttt ttttggaata taaataagct cgaagtcgac gaattcatga |
| 901 cagtactagc tccagcttgg tccccgacaa cataccttct actactacta ttgctatcct |
| 961 ccggactatc tggaacccag gattgctctt ttcagcactc tccgatctcg tctgatttcg |
| 1021 cggttaagat cagagagcta tccgactact tgctacagga ttacccagta accgtcgcgt |
| 1081 ccaacctaca agatgaagaa ctatgtggtg gactttggag actagtccta gcgcaaagat |
| 1141 ggatggaaag acttaagacc gtagcgggat ctaagatgca gggactacta gaaagagtca |

TABLE 4-continued

Exemplary nucleotide sequences for the open reading frames of the recombinant VACVΔE5R constructs of the present technology.

```
1201 acaccgagat ccacttcgtc acaaagtgtg cgtttcaacc accaccgtcc tgtctaagat
1261 tcgtccagac aaacatctcc agactactac aagaaacctc cgagcagcta gtagcgctaa
1321 aaccgtggat cacaagacag aacttctcga gatgtctaga gctacagtgt cagccggatt
1381 cttctacatt accaccacca tggtcaccaa gaccactaga agctacagct ccaactgctc
1441 cacaaccacc attgctactt ttgctattgc tacccgtcgg attgctacta ttagctgctg
1501 cttggtgtct acactggcag agaactagaa gaagaactcc aagaccggga gaacaagtac
1561 caccagtacc atctccacag gacctactac tagtcgagca cagaagaaga agaagatcgg
1621 gagcgaccaa cttctcgcta ttgaaacaag cgggagatgt cgaagaaaat ccgggaccaa
1681 tggagggcga gggggtccag cctctggacg agaacctcga aaacgggtct cgccctcgct
1741 ttaaatggaa gaagactctt aggctcgttg taagcggcat caagggggcc ggtatgttgc
1801 tgtgcttcat atatgtgtgt ttgcaactta gctcttcacc tgcaaaagac ccccccatac
1861 aacgccttcg gggggctgtg acccgctgtg aagatggtca attgtttatt tcttcttaca
1921 agaacgagta tcagacgatg gaagtccaga ataactccgt agtgattaag tgtgacggac
1981 tgtacatcat ctacttgaaa ggatcttttt tccaggaggt caaaattgac ctccacttca
2041 gggaggatca caaccctatc tcaatcccta tgttgaacga cggcagaaga atcgtcttta
2101 ctgtagtcgc ttcactggcc ttcaaggata aggtgtactt gaccgtaaac gctcctgata
2161 ccttgtgcga gcatttgcaa atcaacgatg gagaacttat cgttgtccaa ctcacaccag
2221 gttactgtgc tcctgagggc agttatcaca gtacagtgaa ccaagtccca ctgtgagtta
2281 acctgcattt catctttctc caatactaat tcaaattgtt aaattaataa tggatagtat
2341 aaatagttat tagtgataaa atagtaaaaa taattattag aataagagtg tagtatcata
2401 gataactctc ttctataaaa atggatttta ttcgtagaaa gtatcttata tacacagtag
2461 aaaataatat agatttttta aaggatgata cattaagtaa agtaaacaat tttaccctca
2521 atcatgtact agctctcaag tatctagtta gcaattttcc tcaacatgtt attactaagg
2581 atgtattagc taataccaat ttttttgttt tcatacatat ggtacgatgt tgtaaagtgt
2641 acgaagcggt tttacgacac gcatttgatg cacccacgtt gtacgttaaa gcattgacta
2701 agaattattg gatcccgggc ccgtcgacca agcttggcgt aatcatggtc atagctgttt
2761 cctgtgtgaa attgttatcc gctcacaatt ccacacaaca tacgagccgg aagcataaag
2821 tgtaaagcct ggggtgccta atgagtgagc taactcacat taattgcgtt gcgctcactg
2881 cccgctttcc agtcgggaaa cctgtcgtgc cagctgcatt aatgaatcgg ccaacgcgcg
2941 gggagaggcg gtttgcgtat tgggcgctct tccgcttcct cgctcactga ctcgctgcgc
3001 tcggtcgttc ggctgcggcg agcggtatca gctcactcaa aggcggtaat acggttatcc
3061 acagaatcag gggataacgc aggaaagaac atgtgagcaa aaggccagca aaaggccagg
3121 aaccgtaaaa aggccgcgtt gctggcgttt ttccataggc tccgcccccc tgacgagcat
3181 cacaaaaatc gacgctcaag tcagaggtgg cgaaacccga caggactata aagataccag
3241 gcgtttcccc ctggaagctc cctcgtgcgc tctcctgttc cgaccctgcc gcttaccgga
3301 tacctgtccg cctttctccc ttcgggaagc gtggcgcttt ctcatagctc acgctgtagg
3361 tatctcagtt cggtgtaggt cgttcgctcc aagctgggct gtgtgcacga accccccgtt
3421 cagcccgacc gctgcgcctt atccggtaac tatcgtcttg agtccaaccc ggtaagacac
```

TABLE 4-continued

| Exemplary nucleotide sequences for the open reading frames of the recombinant VACVΔE5R constructs of the present technology. |
|---|
| 3481 gacttatcgc cactggcagc agccactggt aacaggatta gcagagcgag gtatgtaggc |
| 3541 ggtgctacag agttcttgaa gtggtggcct aactacggct acactagaag aacagtattt |
| 3601 ggtatctgcg ctctgctgaa gccagttacc ttcggaaaaa gagttggtag ctcttgatcc |
| 3661 ggcaaacaaa ccaccgctgg tagcggtggt ttttttgttt gcaagcagca gattacgcgc |
| 3721 agaaaaaaag gatctcaaga agatcctttg atcttttcta cggggtctga cgctcagtgg |
| 3781 aacgaaaact cacgttaagg gattttggtc atgagattat caaaaaggat cttcacctag |
| 3841 atccttttaa attaaaaatg aagttttaaa tcaatctaaa gtatatatga gtaaacttgg |
| 3901 tctgacagtt accaatgctt aatcagtgag gcacctatct cagcgatctg tctatttcgt |
| 3961 tcatccatag ttgcctgact ccccgtcgtg tagataacta cgatacggga gggcttacca |
| 4021 tctggcccca gtgctgcaat gataccgcga gacccacgct caccggctcc agatttatca |
| 4081 gcaataaacc agccagccgg aagggccgag cgcagaagtg gtcctgcaac tttatccgcc |
| 4141 tccatccagt ctattaattg ttgccgggaa gctagagtaa gtagttcgcc agttaatagt |
| 4201 ttgcgcaacg ttgttgccat tgctacaggc atcgtggtgt cacgctcgtc gtttggtatg |
| 4261 gcttcattca gctccggttc ccaacgatca aggcgagtta catgatcccc catgttgtgc |
| 4321 aaaaaagcgg ttagctcctt cggtcctccg atcgttgtca gaagtaagtt ggccgcagtg |
| 4381 ttatcactca tggttatggc agcactgcat aattctctta ctgtcatgcc atccgtaaga |
| 4441 tgcttttctg tgactggtga gtactcaacc aagtcattct gagaatagtg tatgcggcga |
| 4501 ccgagttgct cttgcccggc gtcaatacgg gataataccg cgccacatag cagaacttta |
| 4561 aaagtgctca tcattggaaa acgttcttcg gggcgaaaac tctcaaggat cttaccgctg |
| 4621 ttgagatcca gttcgatgta acccactcgt gcacccaact gatcttcagc atcttttact |
| 4681 ttcaccagcg tttctgggtg agcaaaaaca ggaaggcaaa atgccgcaaa aaagggaata |
| 4741 agggcgacac ggaaatgttg aatactcata ctcttccttt ttcaatatta ttgaagcatt |
| 4801 tatcagggtt attgtctcat gagcggatac atatttgaat gtatttagaa aaataaacaa |
| 4861 ataggggttc cgcgcacatt tccccgaaaa gtgccacctg acgtctaaga aaccattatt |
| 4921 atcatgacat taacctataa aaataggcgt atcacgaggc cctttcgtc |

In some embodiments, engineered VACVΔE5R virus is generated by inserting an expression construct such as those illustrated by SEQ ID NOs: 26-28 (Table 4) into the VACV genomic region that corresponds to the position of the E5R locus (e.g., position 49,236 to 50,261 of SEQ ID NO: 2).

A non-limiting example of an anti-CTLA-4 antibody open reading for insertion into the TK locus of VACV, using, e.g., a pCB plasmid-based vector, is shown in SEQ ID NO: 29 (Table 5).

TABLE 5

| Exemplary nucleotide sequence for the open reading frames of the vaccinia virus constructs of the present technology. |
|---|
| anti-muCTLA4-muIgG2a nucleotide sequence. (SEQ ID NO: 29) |
| *5'ATGGAATGGTCCTTTGTCTTTCTTTTTTTCTTGTCCGCAGCTGCCGGAGTACATTCG* |
| *GAG*GCGAAGTTGCAAGAGTCCGGACCTGTACTTGTTAAGCCCGGAGCTTCAGT |
| GAAAATGTCCTGTAAAGCATCCGGATATACCTTTACAGATTATTATATGAATTG |
| GGTGAAGCAAAGTCATGGAAAGAGTCTTGAATGGATAGGAGTAATTAATCCTT |
| ATAACGGAGATACATCTTATAATCAAAAGTTCAAAGGAAAAGCTACACTAACT |
| GTTGATAAATCCTCAAGTACTGCTTATATGGAACTAAACTCACTAACTAGTGAA |

TABLE 5-continued

| Exemplary nucleotide sequence for the open reading frames of the vaccinia virus constructs of the present technology. |
|---|
| GATTCTGCAGTTTATTATTGTGCTCGTTATTATGGTTCGTGGTTTGCATATTGGG |
| GACAGGGAACCTTAATAACTGTAAGTACAGCAAAAACAACGGCGCCTTCTGTT |
| TATCCATTAGCGCCTGTATGTGGAGATACAACTGGTTCTTCTGTTACATTAGGA |
| TGTCTAGTCAAAGGATATTTCCCAGAACCTGTTACATTAACCTGGAACTCCGGT |
| TCGCTATCATCAGGTGTACACACTTTCCCGGCGGTTCTACAATCTGATTTGTAT |
| ACATTATCATCTTCCGTTACAGTTACTTCTTCCACTTGGCCATCGCAAAGTATC |
| ACATGTAACGTAGCGCACCCAGCTTCATCAACAAAAGTCGATAAAAAAATAGA |
| GCCGCGAGGTCCCACTATAAAGCCGTGTCCACCTTGTAAATGTCCAGCTCCTA |
| ATTTATTAGGAGGACCCAGTGTATTTATTTTCCCTCCTAAAATTAAAGATGTAT |
| TGATGATTTCTTTATCTCCAATTGTTACATGCGTGGTTGTAGATGTATCCGAAG |
| ACGATCCGGATGTGCAAATATCGTGGTTCGTTAATAATGTGGAAGTTCACACC |
| GCGCAAACTCAAACTCACAGAGAGGATTACAATTCTACCTTGCGTGTAGTGTC |
| GGCTCTACCTATACAACACCAAGATTGGATGTCTGGAAAAGAATTTAAATGCA |
| AAGTTAATAACAAAGACCTTCCAGCGCCAATAGAAAGAACAATATCCAAACCT |
| AAAGGTAGTGTAAGAGCTCCTCAAGTATACGTTTTACCGCCTCCTGAAGAAGA |
| AATGACGAAAAAACAAGTTACATTAACCTGTATGGTGACAGATTTTATGCCAG |
| AGGATATTTATGTGGAGTGGACTAATAATGGAAAAACGGAATTGAATTACAAA |
| AATACTGAACCTGTATTAGATAGTGATGGATCATATTTTATGTACAGTAAATTG |
| AGAGTGGAAAAAAAGAATTGGGTTGAAAGAAATTCGTACTCTTGTTCAGTTGT |
| ACATGAGGGACTACATAATCATCATACCACTAAGAGTTTTTCAAGAACCCCTG |
| GTAAA**CGTAGAAGGCGTAGGAGATCTGGTGCTACTAATTTCTCCTTGTTAA** |
| **AACAAGCCGGTGACGTCGAAGAAAACCCTGGTCCT***ATGATGACATGGACTCT* |
| *ACTATTCCTTGCCTTCCTTCATCACTTAACAGGGTCATGTGCCG****ACATCGTTATGAC*** |
| ***CCAAACTACTCTTTCATTACCTGTGTCATTAGGAGACCAGGCATCCATCTCATGC*** |
| ***CGATCCTCTCAATCGATAGTACACTCTAATGGAAATACCTATTTAGAATGGTATT*** |
| ***TGCAGAAGCCGGGTCAATCTCCGAAGTTACTAATTTATAAAGTTTCTAACAGATT*** |
| ***TTCAGGAGTTCCAGATAGATTTAGTGGTTCAGGATCCGGTACTGACTTTACATTA*** |
| ***AAGATCTCTCGTGTAGAAGCTGAGGATCTTGGTGTATATTATTGTTTCCAAGGAT*** |
| ***CTCACGTCCCATATACTTTCGGAGGAGGAACCAAACTAGAAATTAAGCGTGCTG*** |
| ***ATGCGGCTCCCACAGTAAGTATATTCCCACCGTCGTCAGAACAATTAACCTCGGG*** |
| ***AGGAGCCTCGGTCGTTTGTTTCTTAAATAACTTTTATCCTAAGGATATCAACGTT*** |
| ***AAATGGAAAATTGATGGTTCTGAACGTCAGAATGGAGTGTTGAATTCATGGACT*** |
| ***GATCAAGATTCCAAAGACTCTACTTATTCGATGTCGAGTACACTTACTTTAACAA*** |
| ***AAGATGAATATGAACGACATAACTCATATACTTGTGAAGCAACCCATAAGACATC*** |
| ***TACTTCACCAATTGTAAAGTCTTTTAATCGAAACGAATGCTAA*** |

*ITALICS UPPER CASE* = human IgG kappa leader sequence
UPPER CASE UNDERLINED = anti-CTLA-4 Heavy Chain
BOLD UPPER CASE = Furin cleavage site
BOLD UPPER CASE UNDERLINED = Pep2A
*BOLD UPPER CASE ITALICS* = anti-CTLA-4 Light Chain Non-limiting examples of IL-12 expression constructs for insertion into, for example, the E5R locus, using, for example, a pUC57 vector, according to the present technology by which, for example, the VACV-E3LΔ83N-ΔTK-anti-CTLA-4-ΔE5R-hFl3L-OX40L-hIL-12 constuct is engineered are shown in SEQ ID NOs: 35-38 (Table 5A) (see also FIG. 169).

TABLE 5A

Exemplary nucleotide sequences for IL-12 expression constructs of the present technology (human and murine IL-12 fusion proteins).

Human IL-12 nucleic acid sequence (SEQ ID NO: 35)

ATGTGTCACCAGCAGCTAGTGATCTCGTGGTTCTCCCTAGTATTTCTAGCCTCTCCGCTAGTAGC

GATCTGGGAGCTAAAAAAGGATGTCTACGTCGTCGAGCTAGACTGGTATCCAGATGCTCCGGGA

GAAATGGTAGTCCTAACATGTGATACACCGGAAGAGGATGGAATCACCTGGACCTTGGATCAAT

CCTCCGAAGTACTAGGATCCGGAAAGACCCTAACCATCCAAGTCAAAGAATTCGGAGATGCGG

GACAGTACACCTGTCACAAAGGTGGAGAAGTCCTATCGCACTCCCTACTACTATTGCACAAGAA

AGAGGACGGTATCTGGTCCACCGATATCCTAAAGGATCAGAAAGAGCCGAAGAACAAGACCTT

CCTAAGATGCGAAGCGAAGAACTACTCCGGAAGATTCACATGTTGGTGGCTAACCACAATCTCC

ACCGACCTAACCTTCTCCGTCAAATCTTCTAGAGGATCCAGTGATCCGCAGGGTGTAACATGTG

GTGCTGCTACATTATCTGCGGAGAGAGTCAGAGGAGACAACAAAGAGTACGAGTACTCCGTCG

AGTGTCAAGAGGATTCTGCTTGTCCAGCTGCGGAAGAATCTCTACCGATCGAAGTAATGGTAGA

CGCGGTCCACAAGTTGAAGTACGAGAACTACACCTCCTCGTTCTTCATCAGAGACATCATCAAA

CCAGATCCGCCGAAGAATCTACAGCTAAAGCCGCTAAAGAACTCCAGACAGGTCGAAGTATCT

TGGGAATACCCGGATACTTGGTCTACACCGCACTCCTACTTTTCGTTGACCTTCTGTGTACAAGT

CCAGGGAAAGTCCAAGAGAGAGAAGAAGGACAGAGTCTTTACCGACAAGACATCCGCGACCGT

CATCTGTAGAAAGAACGCCTCTATTTCTGTCAGAGCGCAGGACAGATATTACTCCTCGTCTTGG

AGTGAATGGGCGTCTGTACCATGTTCCAGAAGAAGAAGAAGAGCGACCAACTTCTCGCTA

TTGAAGCAAGCGGGAGATGTAGAAGAAAATCCGGGACCGTTAGATATGTGTCCGGCGAGATCT

CTACTACTAGTCGCGACACTAGTCCTACTAGACCATCTATCTCTAGCGAGAAATTTGCCAGTAGC

GACACCAGATCCTGGAATGTTTCCGTGTCTACACCACTCGCAGAATCTACTAAGAGCCGTGTCT

AACATGCTACAGAAGGCGAGACAGACCTTGGAATTCTACCCGTGTACCTCCGAAGAAATCGATC

ACGAGGATATCACCAAGGACAAGACCTCTACAGTCGAAGCTTGTCTACCGCTAGAGTTGACCAA

GAACGAGTCCTGCCTAAACTCCAGAGAAACCTCCTTCATCACCAACGGATCTTGCCTAGCGTCT

AGAAAGACCTCTTTCATGATGGCGCTATGCCTATCCTCTATCTACGAGGACCTAAAGATGTACC

AGGTCGAATTCAAGACCATGAACGCGAAGCTACTAATGGACCCGAAGAGACAGATCTTCTTGG

ACCAGAATATGCTAGCGGTCATCGACGAACTAATGCAGGCGCTAAACTTCAACTCTGAAACCGT

GCCGCAGAAGTCCAGTTTAGAAGAACCGGATTTCTACAAGACCAAGATCAAGCTATGCATCCTA

CTACACGCGTTCAGAATCAGAGCGGTCACCATCGATAGAGTCATGTCTTACCTAAACGCGTCCA

GAAGACCGAAAGGAAGAGGAAAGAGAAGAAGAGAAAAGCAAAGACCGACCGACTGCCATCTA

TGA

HuIL12p40-PEP2A-huIL12p35-AA-PIGF-AA amino acid sequence (SEQ ID NO: 36)

MCHQQLVISWFSLVFLASPLVAIWELKKDVYVVELDWYPDAPGEMVVLTCDTPEEDGITW

TLDQSSEVLGSGKTLTIQVKEFGDAGQYTCHKGGEVLSHSLLLLHKKEDGIWSTDILKDQ

KEPKNKTFLRCEAKNYSGRFTCWWLTTISTDLTFSVKSSRGSSDPQGVTCGAATLSAERV

RGDNKEYEYSVECQEDSACPAAEESLPIEVMVDAVHKLKYENYTSSFFIRDIIKPDPPKN

TABLE 5A-continued

| Exemplary nucleotide sequences for IL-12 expression constructs of the present technology (human and murine IL-12 fusion proteins). |
|---|
| LQLKPLKNSRQVEVSWEYPDTWSTPHSYFSLTFCVQVQGKSKREKKDRVFTDKTSATVIC |
| RKNASISVRAQDRYYSSSWSEWASVPCS |
| RRRRRRATNFSLLKQAGDVEENPGPLD |
| MCPARSLLLVATLVLLDHLSLARNLPVATPDPGMFPCLHHSQNLLRAVSNMLQKARQTLE |
| FYPCTSEEIDHEDITKDKTSTVEACLPLELTKNESCLNSRETSFITNGSCLASRKTSEMM |
| ALCLSSIYEDLKMYQVEFKTMNAKLLMDPKRQIFLDQNMLAVIDELMQALNENSETVPQK |
| SSLEEPDFYKTKIKLCILLHAFRIRAVTIDRVMSYLNAS |
| **RRPKGRGKRRREKQRPTDCHL** |
| UNDERLINED = PEP2A sequence |
| **BOLD UNDERLINED** = Matrix binding tag |
| Murine IL-12 nucleic acid sequence (SEQ ID NO: 37) |
| (SEQ ID NO: 35) |
| ATGTGTCCACAAAAGCTCACCATCTCATGGTTCGCTATAGTATTGCTCGTTTCCCCATTGATGGC |
| AATGTGGGAGCTTGAAAAAGATGTGTATGTAGTGGAGGTTGACTGGACTCCTGATGCACCCGGA |
| GAGACAGTCAATTTGACATGCGACACCCCCGAAGAAGATGATATTACATGGACATCCGACCAA |
| CGGCACGGGGTCATCGGATCTGGGAAGACCTTGACAATTACAGTGAAGGAGTTCTTGGATGCAG |
| GACAGTACACATGTCATAAAGGGGGCGAGACACTCTCACATTCACATCTGCTCCTGCATAAAAA |
| GGAGAACGGAATCTGGTCCACCGAAATCCTTAAGAATTTCAAGAACAAAACCTTTCTTAAGTGT |
| GAGGCCCCTAATTATTCCGGAAGATTTACATGCAGCTGGTTGGTCCAGCGCAATATGGACCTCA |
| AATTTAATATCAAGTCTTCTTCCAGCTCCCCAGATTCTCGGGCAGTGACTTGCGGCATGGCATCC |
| CTCTCCGCTGAGAAAGTAACATTGGATCAACGAGACTACGAGAAGTACTCTGTTAGTTGTCAAG |
| AGGACGTTACATGCCCTACCGCAGAAGAGACATTGCCAATTGAATTGGCCCTTGAAGCACGCCA |
| GCAGAATAAGTACGAAAATTACAGTACAAGCTTTTTCATCCGAGACATAATTAAACCCGATCCT |
| CCTAAGAATCTCCAAATGAAACCTTTGAAGAATAGCCAAGTGGAAGTTTCATGGGAGTATCCAG |
| ATTCCTGGTCCACACCACATTCCTATTTCTCCCTTAAGTTCTTCGTCAGAATCCAGAGGAAGAAA |
| GAAAAGATGAAGGAAACCGAGGAAGGCTGCAACCAGAAGGGCGCCTTTCTGGTAGAGAAAAC |
| CAGCACTGAGGTTCAGTGTAAGGGGGGAAACGTGTGTGTGCAGGCACAAGATCGATACTACAA |
| CTCAAGCTGTAGTAAATGGGCCTGCGTACCTTGTCGGGTTCGATCCAGACGACGCCGGAGACGA |
| GCTACCAATTTTTCCTTGCTCAAGCAGGCAGGCGATGTGGAGGAAAACCCAGGGCCCCTTGACA |
| TGTGTCAGAGCCGGTACCTCCTTTTCCTCGCAACCCTGGCTCTGCTTAACCACCTCTCACTGGCT |
| AGGGTAATTCCCGTATCTGGGCCTGCCCGATGCCTCAGCCAGAGTCGGAATCTCCTTAAGACCA |
| CAGACGATATGGTAAAAACAGCAAGGGAGAAACTCAAACATTACTCTTGTACAGCAGAGGACA |
| TCGATCATGAAGACATAACCCGGGACCAGACCTCAACATTGAAAACTTGTCTGCCACTGGAGCT |
| TCATAAGAACGAGTCCTGCCTTGCCACACGAGAGACCTCTAGCACTACACGGGGGTCCTGCCTG |
| CCTCCACAGAAAACCTCCTTGATGATGACCCTGTGTCTCGGCAGTATTTACGAAGATTTGAAGA |
| TGTACCAAACAGAGTTTCAGGCCATTAACGCAGCATTGCAAAACCATAATCACCAGCAGATAAT |
| CCTTGATAAGGGTATGCTGGTAGCCATCGACGAACTTATGCAATCTCTGAATCATAATGGCGAA |
| ACTCTGCGACAAAAGCCCCCAGTTGGAGAAGCCGACCCCTACCGAGTCAAGATGAAACTCTGC |
| ATACTCCTGCATGCCTTTTCCACACGGGTTGTTACTATCAATCGAGTCATGGGGTATCTTTCTTC |

TABLE 5A-continued

| Exemplary nucleotide sequences for IL-12 expression constructs of the present technology (human and murine IL-12 fusion proteins). |
|---|
| AGCACGGCGCCCTAAAGGGCGCGGAAAACGCCGCCGGGAAAAACAAAGACCTACTGATTGCCA |
| TCTGTGA |
| Murine IL-12 fusion protein amino acid sequence (SEQ ID NO: 38) |
| MCPQKLTISWFAIVLLVSPLMAMWELEKDVYVVEVDWTPDAPGETVNLTCDTPEEDDITWTSDQRH |
| GVIGSGKTLTITVKEFLDAGQYTCHKGGETLSHSHLLLHKKENGIWSTEILKNFKNKTFLKCEAPN |
| YSGRFTCSWLVQRNMDLKENIKSSSSSPDSRAVTCGMASLSAEKVTLDQRDYEKYSVSCQEDVTCP |
| TAEETLPIELALEARQQNKYENYSTSFFIRDIIKPDPPKNLQMKPLKNSQVEVSWEYPDSWSTPHS |
| YFSLKFFVRIQRKKEKMKETEEGCNQKGAFLVEKTSTEVQCKGGNVCVQAQDRYYNSSCSKWACVP |
| CRVRSRRRRRRATNFSLLKQAGDVEENPGPLDMCQSRYLLFLATLALLNHLSLARVIPVSGPARCL |
| SQSRNLLKTTDDMVKTAREKLKHYSCTAEDIDHEDITRDQTSTLKTCLPLELHKNESCLATRETSS |
| TTRGSCLPPQKTSLMMTLCLGSIYEDLKMYQTEFQAINAALQNHNHQQIILDKGMLVAIDELMQSL |
| NHNGETLRQKPPVGEADPYRVKMKLCILLHAFSTRVVTINRVMGYLSSA**RRPKGRGKRRREKQRPT** |
| **DCHL*** |
| UNDERLINED = PEP2A sequence |
| **BOLD UNDERLINED** = Matrix binding tag |

In some embodiments, engineered VACV viruses of the present technology comprise an expression construct such as that illustrated by SEQ ID NO: 29 (Table 5) inserted into the VACV genomic region that corresponds to the position of the TK locus (e.g., position 80,962 to 81,032 of SEQ ID NO: 2).

VACVΔB2R

The VACV B2R gene encodes poxin, a nuclease that plays a role in viral evasion of host cGAS-STING innate immunity. The disclosure of the present technology relates to a B2R mutant vaccinia virus (i.e., VACVΔB2R; VACV comprising a B2R deletion; VACV genetically engineered to comprise a mutant B2R gene), or immunogenic compositions comprising the virus, in which the virus is engineered to express one or more specific genes of interest (SG), such as OX40L (VACVΔB2R-OX40L), and its use as a cancer immunotherapeutic. In some embodiments, the B2R gene of the vaccinia virus, through homologous recombination techniques, is engineered to contain a disruption comprising a heterologous nucleic acid sequence comprising one or more expression cassettes, which result in a B2R knockout such that the B2R gene is not expressed, expressed at levels so low as to have no effect, or the expressed protein is non-functional (e.g., is a null-mutation). In some embodiments, the ΔB2R mutant includes a heterologous nucleic acid sequence in place of all or a majority of the B2R gene sequence. For example, in some embodiments, the nucleic acid sequence corresponding to the position of B2R in the VACV genome (e.g., position 164,856 to 165,530 of SEQ ID NO: 2) is replaced with a heterologous nucleic acid sequence. In some embodiments, the heterologous nucleic acid sequence comprises an open reading frame that encodes a selectable marker. In some embodiments, the selectable marker is a fluorescent protein (e.g., gpt, GFP, mCherry). In some embodiments, the VACVΔB2R virus encompasses a recombinant VACV that does not express a functional B2R protein. In some embodiments, a specific gene of interest (e.g., OX40L, hFlt3L) is inserted into the B2R locus of the VACV genome, splitting the B2R gene and obliterating it.

Additionally or alternatively, in some embodiments, VACVΔB2R is engineered to express both OX40L and hFlt3L. In some embodiments, the thymidine kinase (TK) gene of the vaccinia virus (e.g., position 80,962 to 81,032 of SEQ ID NO: 2), through homologous recombination, is engineered to contain a disruption comprising a heterologous nucleic acid sequence comprising one or more expression cassettes, which results in a TK gene knockout such that the TK gene is not expressed, expressed at levels so low as to have no effect, or the expressed protein is non-functional (e.g., is a null-mutation). The resulting VACVΔB2R-TK(−) virus is further engineered to comprise one or more expression cassettes that are flanked by a partial sequence of the TK gene (TK-L and TK-R) on either side. In some embodiments, the expression cassette comprises a single open reading frame that encodes a specific gene of interest (SG), such as OX40L using the vaccinia viral synthetic early and late promoter (PsE/L), resulting in VACVΔB2R-TK(−)-OX40L. In some embodiments, the recombinant virus is further modified at the B2R locus, through homologous recombination techniques, to contain a disruption comprising a heterologous nucleic acid sequence comprising one or more expression cassettes, which result in a B2R knockout such that the B2R gene is not expressed, expressed at levels so low as to have no effect, or the expressed protein is non-functional (e.g., is a null-mutation). In some embodiments, the expression cassette comprises a single open reading frame that encodes a specific gene of interest (SG), such as hFlt3L, resulting in VACVΔB2R-hFlt3L-TK(−)-OX40L. In some embodiments, the expression cassette encoding OX40L is inserted into the B2R locus while the expression cassette encoding hFlt3L is inserted into the TK locus. In some embodiments, a VACVΔB2R-anti-CTLA-4-hFlt3L-TK(−) virus is further modified to encode OX40L, resulting in VACVΔB2R-anti-CTLA-4-TK(−)-hFlt3L-

OX40L. In some embodiments, the VACVΔB2R-anti-CTLA-4-TK(−)-hFlt3L-OX40L virus is further modified to express hIL-12, resulting in VACVΔB2R-anti-CTLA-4-TK(−)-hFlt3L-OX40L-hIL-12. In some embodiments, a VACVΔE3L83N-ΔTK-anti-CTLA-4-ΔE5R-hFl3L-OX40L-hIL-12 genome is modified to comprise a B2R deletion (VACVΔE3L83N-ΔTK-anti-CTLA-4-ΔE5R-hFl3L-OX40L-IL-12-ΔB2R) (see, e.g., FIG. 168).

Additionally or alternatively, in some embodiments, the heterologous nucleic acid sequence comprises an expression cassette comprising two or more open reading frames encoding two or more specific genes of interest, separated by a nucleotide sequence that encodes, in the 5' to 3' direction, a protease cleavage site (e.g., a furin cleavage site) and a 2A peptide (Pep2A) sequence.

In some embodiments, the genetically engineered or recombinant VACVΔB2R viruses described above are modified to express at least one heterologous gene, such as any one or more of hOX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one other viral gene mutation or deletion, such as any one or more of the following deletions: E3L (ΔE3L); E3LΔ83N; C7 (ΔC7L); B19R (B18R; ΔWR200); E5R (ΔE5R); K7R; C12L (IL18BP); B8R; B14R; N1L; C11R; K1L; M1L; N2L; and/or WR199. In some embodiments, the genetically engineered or recombinant VACVΔB2R viruses are selected from VACVΔB2R-ΔE5R, VACVΔB2R-ΔE5R-E3LΔ83N, and VACVΔB2R-E3LΔ83N. In other embodiments, no further heterologous genes are added other than those provided in the name of the virus herein, and/or no further viral genes are disrupted or deleted other than those provided in the name of the virus herein.

Although in certain embodiments described above, the transgene may be inserted into the B2R locus, splitting the B2R gene and obliterating it or replacing it, other suitable integration loci can be selected. For example, VACV encodes several immune modulatory genes, including but not limited to C7, C11, K3, F1, F2, F4, F6, F8, F9, F11, F14.5, J2, A46, E3L, B18R (WR200), E5R, K7R, C12L, B8R, B14R, N1L, C11R, K1L, C16, M1L, N2L, and WR199. Accordingly, in some embodiments, these genes can be deleted to potentially enhance immune activating properties of the virus and allow insertion of transgenes.

In some embodiments, the heterologous nucleotide sequence further comprises an additional expression cassette comprising an open reading frame that encodes a selectable marker operably linked to a promoter that is capable of directing expression of the selectable marker. In some embodiments, the selectable marker is a xanthine-guanine phosphoribosyl transferase (gpt) gene. In some embodiments, the selectable marker is a green fluorescent protein (GFP) gene. In some embodiments, the selectable marker is an mCherry gene encoding a red fluorescent protein.

A non-limiting example of a VACVΔB2R deletion construct comprising an open reading frame encoding a selectable marker according to the present technology is shown in SEQ ID NO: 30 (Table 7).

TABLE 7

Exemplary nucleotide sequences for the open reading frames of the recombinant VACVAB2R constructs of the present technology.

B2R-FRT GFP Kan plasmid nucleic acid sequence
(SEQ ID NO: 30)

GTCTATACAAATCCATTAATGTGGAATATCGATTCTTGGTAATTAATAGATTAG

GTGCAGATCTAGATGCGGTGATCAGAGCCAATAATAATAGATTACCAAAAAGG

TCGGTGATGTTGATCGGAATCGAAATCTTAAATACCATACAATTTATGCACGA

GCAAGGATATTCTCACGGAGATATTAAAGCGAGTAATATAGTCTTGGATCAAA

TAGATAAGAATAAATTATATCTAGTGGATTACGGATTGGTTTCTAAATTCATGT

CTAATGGAGAACATGTTCCATTTATAAGAAATCCAAATAAAATGGATAACGGT

ACTCTAGAATTTACACCTATAGATTCGCATAAAGGATACGTTGTATCTAGACGT

GGAGATCTAGAAACACTTGGATATTGTATGATTAGATGGTTGGGAGGTATCTT

GCCATGGACTAAGATATCTGAAACAAAGAATTGTGCATTAGTAAGTGCCACAA

AACAGAAATATGTTAACAATACTGCGACTTTGTTAATGACCAGTTTGCAATATG

CACCTAGAGAATTGCTGCAATATATTACCATGGTAAACTCTTTGACATATTTTG

AGGAACCCAATTATGACGAGTTTCGGCACATATTAATGCAGGGTGTATATTATT

AAGTGTGGTGTTTGGTCGATGTAAAATTTTTGTCGATAAAAATTAAAAAATAA

CTTAATTTATTATTGATCTCGTGTATAAGCTAGCGCGGTTAACCGCCTTTTTATC

CATCAGGTGATCTGTTTTTATTGTGGAGTCTAGAACTAGTGGATCCCCCGGGCT

GCAGGAATTCGATATCAAGCTCAGGCCTAGATCTGTCGACTTCGAGCTTATTTA

TATTCCAAAAAAAAAAAATAAAATTTCAATTTTTAAGCTTTTGAAGTTCCTATA

CTTTCTAGAGAATAGGAACTTCCACTAATTCCAAACCCACCCGCTTTTTATAGT

AAGTTTTTCACCCATAAATAATAAATACAATAATTAATTTCTCGTAAAAGTAGA

TABLE 7-continued

Exemplary nucleotide sequences for the open reading frames of the recombinant VACVAB2R constructs of the present technology.

AAATATATTCTAATTTATTGCACGGTAAGGAAGTAGATCATAACTCGAGGAAT

TGGGGATCTCTATAATCTCGCGCAACCTATTTTCCCCTCGAACACTTTTTAAGC

CGTAGATAAACAGGCTGGGACACTTCACACGCGTATGGTGAGCAAGGGCGAG

GAGCTGTTCACCGGGGTGGTGCCCATCCTGGTCGAGCTGGACGGCGACGTAAA

CGGCCACAAGTTCAGCGTGTCCGGCGAGGGCGAGGGCGATGCCACCTACGGC

AAGCTGACCCTGAAGTTCATCTGCACCACCGGCAAGCTGCCCGTGCCCTGGCC

CACCCTCGTGACCACCCTGACCTACGGCGTGCAGTGCTTCAGCCGCTACCCCG

ACCACATGAAGCAGCACGACTTCTTCAAGTCCGCCATGCCCGAAGGCTACGTC

CAGGAGCGCACCATCTTCTTCAAGGACGACGGCAACTACAAGACCCGCGCCGA

GGTGAAGTTCGAGGGCGACACCCTGGTGAACCGCATCGAGCTGAAGGGCATC

GACTTCAAGGAGGACGGCAACATCCTGGGGCACAAGCTGGAGTACAACTACA

ACAGCCACAACGTCTATATCATGGCCGACAAGCAGAAGAACGGCATCAAGGT

GAACTTCAAGATCCGCCACAACATCGAGGACGGCAGCGTGCAGCTCGCCGACC

ACTACCAGCAGAACACCCCCATCGGCGACGGCCCCGTGCTGCTGCCCGACAAC

CACTACCTGAGCACCCAGTCCAAGCTGAGCAAAGACCCCAACGAGAAGCGCG

ATCACATGGTCCTGCTGGAGTTCGTGACCGCCGCCGGGATCACTCTCGGCATG

GACGAGCTGTACAAGTAATGAAGTTCCTATACTTTCTAGAGAATAGGAACTTC

CGGTTAACCGGTGATATCACCTCTCTGGAAGACAGCGTGAATAATGTACTCAT

GAAACGTTTGGAAACTATACGCCATATGTGGTCTGTCGTATATGATCATTTTGA

TATTGTGAATGGTAAAGAATGCTGTTATGTGCATACGCATTTGTCTAATCAAAA

TCTTATACCGAGTACTGTAAAAACAAATTTGTACATGAAGACTATGGGATCAT

GCATTCAAATGGATTCCATGGAAGCTCTAGAGTATCTTAGCGAACTGAAGGAA

TCAGGTGGATGGAGTCCCAGACCAGAAATGCAGGAATTTGAATATCCAGATGG

AGTGGAAGACACTGAATCAATTGAGAGATTGGTAGAGGAGTTCTTCAATAGAT

CAGAACTTCAGGCTGGTGAATCAGTCAAATTTGGTAATTCTATTAATGTTAAAC

ATACATCTGTTTCAGCTAAGCAACTAAGAACACGTATACGGCAGCAGCTTCCTT

TATACTCTCATCTTTTACCAACACAAAGGGTGGATATTTGTTCATTGGAGTTGA

TAATAATACACACAAAGTAATTGGATTCACGGTGGGTCATGACTACCTCAGAC

TGGTAGAGAATGATATAGAAAAGCATATCAAAAGACTTCGTGTTGTGCATTTC

TGTGAGAAGAAAGAGGACATCAAGTACACGTGTCGATTCATCAAGGTATATAA

ACCTGGGGATGAGGCTTCACGTAGAAAGCCAGTCCGCAGAAACGGTGCTGACC

CCGGATGAATGTCAGCTACTGGGCTATCTGGACAAGGGAAAACGCAAGCGCA

AAGAGAAAGCAGGTAGCTTGCAGTGGGCTTACATGGCGATAGCTAGACTGGGC

GGTTTTATGGACAGCAAGCGAACCGGAATTGCCAGCTGGGGCGCCCTCTGGTA

AGGTTGGGAAGCCCTGCAAAGTAAACTGGATGGCTTTCTCGCCGCCAAGGATC

TGATGGCGCAGGGGATCAAGCTCTGATCAAGAGACAGGATGAGGATCGTTTCG

CATGATTGAACAAGATGGATTGCACGCAGGTTCTCCGGCCGCTTGGGTGGAGA

GGCTATTCGGCTATGACTGGGCACAACAGACAATCGGCTGCTCTGATGCCGCC

TABLE 7-continued

| Exemplary nucleotide sequences for the open reading frames of the recombinant VACVAB2R constructs of the present technology. |
| --- |
| GTGTTCCGGCTGTCAGCGCAGGGGCGCCCGGTTCTTTTTGTCAAGACCGACCTG |
| TCCGGTGCCCTGAATGAACTGCAAGACGAGGCAGCGCGGCTATCGTGGCTGGC |
| CACGACGGGCGTTCCTTGCGCAGCTGTGCTCGACGTTGTCACTGAAGCGGGAA |
| GGGACTGGCTGCTATTGGGCGAAGTGCCGGGGCAGGATCTCCTGTCATCTCAC |
| CTTGCTCCTGCCGAGAAAGTATCCATCATGGCTGATGCAATGCGGCGGCTGCA |
| TACGCTTGATCCGGCTACCTGCCCATTCGACCACCAAGCGAAACATCGCATCG |
| AGCGAGCACGTACTCGGATGGAAGCCGGTCTTGTCGATCAGGATGATCTGGAC |
| GAAGAGCATCAGGGGCTCGCGCCAGCCGAACTGTTCGCCAGGCTCAAGGCGA |
| GCATGCCCGACGGCGAGGATCTCGTCGTGACCCATGGCGATGCCTGCTTGCCG |
| AATATCATGGTGGAAAATGGCCGCTTTTCTGGATTCATCGACTGTGGCCGGCTG |
| GGTGTGGCGGACCGCTATCAGGACATAGCGTTGGCTACCCGTGATATTGCTGA |
| AGAGCTTGGCGGCGAATGGGCTGACCGCTTCCTCGTGCTTTACGGTATCGCCG |
| CTCCCGATTCGCAGCGCATCGCCTTCTATCGCCTTCTTGACGAGTTCTTCTGAA |
| TTATTAACGCTTACAATTTCCTGATGCGGTATTTTCTCCTTACGCATCTGTGCGG |
| TATTTCACACCGCATACAGGTGGCACTTTTCGGGGAAATGTGCGCGGAACCCC |
| TATTTTCGTTCCACTGAGCGTCAGACCCCGTAGAAAAGATCAAAGGATCTTCTT |
| GAGATCCTTTTTTTCTGCGCGTAATCTGCTGCTTGCAAACAAAAAAACCACCGC |
| TACCAGCGGTGGTTTGTTTGCCGGATCAAGAGCTACCAACTCTTTTTCCGAAGG |
| TAACTGGCTTCAGCAGAGCGCAGATACCAAATACTGTCCTTCTAGTGTAGCCGT |
| AGTTAGGCCACCACTTCAAGAACTCTGTAGCACCGCCTACATACCTCGCTCTGC |
| TAATCCTGTTACCAGTGGCTGCTGCCAGTGGCGATAAGTCGTGTCTTACCGGGT |
| TGGACTCAAGACGATAGTTACCGGATAAGGCGCAGCGGTCGGGCTGAACGGG |
| GGGTTCGTGCACACAGCCCAGCTTGGAGCGAACGACCTACACCGAACTGAGAT |
| ACCTACAGCGTGAGCTATGAGAAAGCGCCACGCTTCCCGAAGGGAGAAAGGC |
| GGACAGGTATCCGGTAAGCGGCAGGGTCGGAACAGGAGAGCGCACGAGGGAG |
| CTTCCAGGGGGAAACGCCTGGTATCTTTATAGTCCTGTCGGGTTTCGCCACCTC |
| TGACTTGAGCGTCGATTTTTGTGATGCTCGTCAGGGGGGCGGAGCCTATGGAA |
| AAACGCCAGCAACGCGGCCTTTTTACGGTTCCTGGGCTTTTGCTGGCCTTTTGC |
| TCACATGTTCTTTCCTGCGTTATCCCCTGATTCTGTGGATAACCGTATTACCGCC |
| TTTGAGTGAGCTGATACCGCTCGCCGCAGCCGAACGACCGAGCGCAGCGAGTC |
| A |

In some embodiments, engineered VACVΔB2R virus is generated by inserting an expression construct such as that illustrated by SEQ ID NO: 30 (Table 7) into the VACV genomic region that corresponds to the position of the B2R locus (e.g., position 164,856 to 165,530 of SEQ ID NO: 2).

MVAΔWR199

A non-limiting example of a MVAΔWR199 construct open reading frame according to the present technology is shown in SEQ ID NO: 34 (Table 8). In some embodiments, MVA comprising a ΔWR199 mutant is generated by inserting an expression construct, with, e.g., a WR199 knockout plasmid, such as that illustrated by SEQ ID NO: 34 into the MVA genomic region that corresponds to the position of the WR199 locus (e.g., position 158,399 to 160,143 of the sequence set forth in GenBank Accession No. AY603355) (see, e.g., FIG. 153).

TABLE 8

| Exemplary nucleotide sequence for the open reading frames of the recombinant MVAΔWR199 construct of the present technology. |
|---|
| WR199-FRT mCherry Kan plasmid nucleic acid sequence (SEQ ID NO: 34) |
| CGTGAATGTATGTTGTTACATTTCCATGTCAATTGAGTTTATAAGAATTTTTATACATTATCTTCC |
| AACAAACAATTGACGAACGTATTGCTATGATTAACTCCCACGATACTATGCATATTATTAATCAT |
| TAACTTGCAGACTATACCTAGTGCTATTTTGACATACTCATGTTCTTGTGTAATTGCGGTATCTAT |
| ATTATTAAAGTACGTAAATCTAGCTATAGTTTTATTATTTAATTTTAGATAATATACCGTCTCCTT |
| ATTTTTAAAAATTGCCACATCCTTTATTAAATCATGAATGGGAATTTCTATGTCATCGTTAATAT |
| ATTGTGAACAACAAGAGCAGATATCTATAGGAAAGGGTGGAATGCGATACATTGATCTATGTA |
| GTTTTAAAACACACGCGAACTTTGAAGAATTTATATAAATCATTCCATCGATACATCCTTCTATG |
| TTGACATGTATATATCCAGGAATTCTTTTATTAATGTCAGGAAATGTATAAACTAAAACATTGCC |
| CGAAAGCGGTGCCTCTATCTGCGTTATATCCGTTCTTAACTTACAAAATGTAACCAATACCTTTG |
| CATGACTTGTTTTGTTCGGCAACGTTAGTTTAAACTTGACGAATGGATTAATTACAATAGCATGA |
| TCCGCGCATCTATTAAGTTTTTTTACTTTAACGCCCTTGTATGTTTTTACAGAGACTTTATCTAAA |
| TTTCTAGTGCTTGTATGTGTTATAAATATAACGGGATATAGAACTGAATCACCTACCTTAGATAC |
| CCAATTACATTTTATCAGATCCAGATAATAAACAAATTTTGTCGCCCTAACTAATTCTATATTGT |
| TATATATTTTACAATTGGTTATGATATCATGTAATAACTTGGAGTCTAACGCGCATCGTCGTACG |
| TTTATACAATTGTGATTTAGTGTAGTATATCTACACATGTATTTTTCCGCACTATAGTATTCTGGA |
| CTAGTGATAAAACTATCGTTATATCTGTCTTCAATGAACTCATCGAGATATTGCTCTCTGTCATA |
| TTCATACACCTGCATAAACTTTCTAGACATCTTACAATCCGTGTTATTTTAGGATCATATTTACAT |
| ATTTACGGGTATATCAAAGATGTTAGATTAGTTAATGGGAATCGTCTATAATAATGAATATTAA |
| ACAATTATATGAGGACTTTAAGCTAGCGCGGTTAACCGCCTTTTTATCCATCAGGTGATCTGTTT |
| TTATTGTGGAGTCTAGAACTAGTGGATCCCCCGGGCTGCAGGAATTCGATATCAAGCTCAGGCC |
| TAGATCTGTCGACTTCGAGCTTATTTATATTCCAAAAAAAAAAAATAAAATTTCAATTTTTAAGC |
| TTTTGAAGTTCCTATACTTTCTAGAGAATAGGAACTTCCACTAATTCCAAACCCACCCGCTTTTT |
| ATAGTAAGTTTTTCACCCATAAATAATAAATACAATAATTAATTTCTCGTAAAAGTAGAAAATA |
| TATTCTAATTTATTGCACGGTAAGGAAGTAGATCATAACTCGAGGAATTGGGGATCTCTATAAT |
| CTCGCGCAACCTATTTTCCCCTCGAACACTTTTTAAGCCGTAGATAAACAGGCTGGGACACTTCA |
| CACGCGTATGGTGAGCAAGGGCGAGGAGGATAACATGGCCATCATCAAGGAGTTCATGCGCTT |
| CAAGGTGCACATGGAGGGCTCCGTGAACGGCCACGAGTTCGAGATCGAGGGCGAGGGCGAGGG |
| CCGCCCCTACGAGGGCACCCAGACCGCCAAGCTGAAGGTGACCAAGGGTGGCCCCCTGCCCTTC |
| GCCTGGGACATCCTGTCCCCTCAGTTCATGTACGGCTCCAAGGCCTACGTGAAGCACCCCGCCG |
| ACATCCCCGACTACTTGAAGCTGTCCTTCCCCGAGGGCTTCAAGTGGGAGCGCGTGATGAACTT |
| CGAGGACGGCGGCGTGGTGACCGTGACCCAGGACTCCTCCCTGCAGGACGGCGAGTTCATCTAC |
| AAGGTGAAGCTGCGCGGCACCAACTTCCCCTCCGACGGCCCCGTAATGCAGAAGAAGACCATG |
| GGCTGGGAGGCCTCCTCCGAGCGGATGTACCCCGAGGACGGCGCCCTGAAGGGCGAGATCAAG |
| CAGAGGCTGAAGCTGAAGGACGGCGGCCACTACGACGCTGAGGTCAAGACCACCTACAAGGCC |
| AAGAAGCCCGTGCAGCTGCCCGGCGCCTACAACGTCAACATCAAGTTGGACATCACCTCCCACA |
| ACGAGGACTACACCATCGTGGAACAGTACGAACGCGCCGAGGGCCGCCACTCCACCGGCGGCA |
| TGGACGAGCTGTACAAGTAATGAAGTTCCTATACTTTCTAGAGAATAGGAACTTCCGGTTAACC |
| GGTGATTGTATTTTTCTCATGCGATGTGTGTAAAAAAACTGATATTATATAAATATTTTAGTGCC |

TABLE 8-continued

| Exemplary nucleotide sequence for the open reading frames of the recombinant MVAΔWR199 construct of the present technology. |
|---|
| GTATAATGAAGATGACGATGAAAATGATGGTACATATATATTTCGTATCATTATTGTTATTGCTA |
| TTCCACAGTTACGCCATAGACATCGAAAATGAAATCACAGAATTCTTCAATAAAATGAGAGATA |
| CTCTACCAGCTAAAGACTCTAAATGGTTGAATCCAGCATGTATGTTCGGAGGCACAATGAATGA |
| TATAGCCGCTCTAGGAGAGCCATTCAGCGCAAAGTGTCCTCCTATTGAAGACAGTCTTTTATCGC |
| ACAGATATAAAGACTATGTGGTTAAATGGGAGAGGCTAGAAAAAAATAGACGGCGACAGGTTT |
| CTAATAAACGTGTTAAACATGGTGATTTATGGATAGCCAACTATACATCTAAATTCAGTAACCG |
| TAGGTATTTGTGTACCGTAACTACAAAGAATGGTGACTGTGTTCAGGGTATAGTTAGATCTCAT |
| ATTAAAAAACCTCCTTCATGCATTCCAAAAACATATGAACTAGGTACTCATGATAAGTATGGCA |
| TAGACTTATACTGTGGAATTCTTTACGCAAAACATTATAATAATATAACTTGGTATAAAGATAAT |
| AAGGAAATTAATATCGACGATATTAAGTATTCACAAACGGGAAAGAAATTAATTATTCATAATC |
| CAGAGTTAGAAGATAGTGGAAGATACAACTGTTACGTTCATTACGACGACGTTAGAATCAAGAT |
| GTAAAATACTTACGGTTATACCGTCGCAAGACCACAGGTTTAAACTAATACTAGATCCAAAAAT |
| CAACGTAACGATAGGAGAACCTGCCAATATAACATGCACTGCTGTGTCAACGTCATTATTGATT |
| GACGATGTACTGATTGAATGGGAAAATCCATCCGGATGGCTTATAGGATTCGATTTTGATGTAT |
| ACTCTGTTTTAACTAGTAGAGGCGGTATCACCGAGGCGACCTTGTACTTTGAAAATGTTACTGA |
| AGAATATATAGGTAATACATATAAATGTCGTGGACACAACTATTATTTTGAAAAAACCCTACAA |
| CTACAGTAGTATTGGAGTCCTTTTCACGTAGAAAGCCAGTCCGCAGAAACGGTGCTGACCCCGG |
| ATGAATGTCAGCTACTGGGCTATCTGGACAAGGGAAAACGCAAGCGCAAAGAGAAAGCAGGTA |
| GCTTGCAGTGGGCTTACATGGCGATAGCTAGACTGGGCGGTTTTATGGACAGCAAGCGAACCGG |
| AATTGCCAGCTGGGGCGCCCTCTGGTAAGGTTGGGAAGCCCTGCAAAGTAAACTGGATGGCTTT |
| CTCGCCGCCAAGGATCTGATGGCGCAGGGGATCAAGCTCTGATCAAGAGACAGGATGAGGATC |
| GTTTCGCATGATTGAACAAGATGGATTGCACGCAGGTTCTCCGGCCGCTTGGGTGGAGAGGCTA |
| TTCGGCTATGACTGGGCACAACAGACAATCGGCTGCTCTGATGCCGCCGTGTTCCGGCTGTCAG |
| CGCAGGGGCGCCCGGTTCTTTTTGTCAAGACCGACCTGTCCGGTGCCCTGAATGAACTGCAAGA |
| CGAGGCAGCGCGGCTATCGTGGCTGGCCACGACGGGCGTTCCTTGCGCAGCTGTGCTCGACGTT |
| GTCACTGAAGCGGGAAGGGACTGGCTGCTATTGGGCGAAGTGCCGGGGCAGGATCTCCTGTCAT |
| CTCACCTTGCTCCTGCCGAGAAAGTATCCATCATGGCTGATGCAATGCGGCGGCTGCATACGCT |
| TGATCCGGCTACCTGCCCATTCGACCACCAAGCGAAACATCGCATCGAGCGAGCACGTACTCGG |
| ATGGAAGCCGGTCTTGTCGATCAGGATGATCTGGACGAAGAGCATCAGGGGCTCGCGCCAGCC |
| GAACTGTTCGCCAGGCTCAAGGCGAGCATGCCCGACGGCGAGGATCTCGTCGTGACCCATGGC |
| GATGCCTGCTTGCCGAATATCATGGTGGAAAATGGCCGCTTTTCTGGATTCATCGACTGTGGCCG |
| GCTGGGTGTGGCGGACCGCTATCAGGACATAGCGTTGGCTACCCGTGATATTGCTGAAGAGCTT |
| GGCGGCGAATGGGCTGACCGCTTCCTCGTGCTTTACGGTATCGCCGCTCCCGATTCGCAGCGCA |
| TCGCCTTCTATCGCCTTCTTGACGAGTTCTTCTGAATTATTAACGCTTACAATTTCCTGATGCGGT |
| ATTTTCTCCTTACGCATCTGTGCGGTATTTCACACCGCATACAGGTGGCACTTTTCGGGGAAATG |
| TGCGCGGAACCCCTATTTTCGTTCCACTGAGCGTCAGACCCCGTAGAAAAGATCAAAGGATCTT |
| CTTGAGATCCTTTTTTTCTGCGCGTAATCTGCTGCTTGCAAACAAAAAAACCACCGCTACCAGCG |
| GTGGTTTGTTTGCCGGATCAAGAGCTACCAACTCTTTTTCCGAAGGTAACTGGCTTCAGCAGAGC |

TABLE 8-continued

| Exemplary nucleotide sequence for the open reading frames of the recombinant MVAΔWR199 construct of the present technology. |
|---|
| GCAGATACCAAATACTGTCCTTCTAGTGTAGCCGTAGTTAGGCCACCACTTCAAGAACTCTGTA |
| GCACCGCCTACATACCTCGCTCTGCTAATCCTGTTACCAGTGGCTGCTGCCAGTGGCGATAAGTC |
| GTGTCTTACCGGGTTGGACTCAAGACGATAGTTACCGGATAAGGCGCAGCGGTCGGGCTGAACG |
| GGGGGTTCGTGCACACAGCCCAGCTTGGAGCGAACGACCTACACCGAACTGAGATACCTACAG |
| CGTGAGCTATGAGAAAGCGCCACGCTTCCCGAAGGGAGAAAGGCGGACAGGTATCCGGTAAGC |
| GGCAGGGTCGGAACAGGAGAGCGCACGAGGGAGCTTCCAGGGGGAAACGCCTGGTATCTTTAT |
| AGTCCTGTCGGGTTTCGCCACCTCTGACTTGAGCGTCGATTTTTGTGATGCTCGTCAGGGGGGCG |
| GAGCCTATGGAAAAACGCCAGCAACGCGGCCTTTTTACGGTTCCTGGGCTTTTGCTGGCCTTTTG |
| CTCACATGTTCTTTCCTGCGTTATCCCCTGATTCTGTGGATAACCGTATTACCGCCTTTGAGTGAG |
| CTGATACCGCTCGCCGCAGCCGAACGACCGAGCGCAGCGAGTCA |

MYXVΔM31R

Myxoma M31R is orthologous to VACV E5R (see FIG. 88B). The disclosure of the present technology relates to a M31R mutant myxoma virus (i.e., MYXVΔM31R; MYXV comprising an M31R deletion; MYXV genetically engineered to comprise a mutant M31R gene), or immunogenic compositions comprising the virus, and its use as a cancer immunotherapeutic. In some embodiments, the MYXVΔM31R virus is engineered to express one or more specific genes of interest (SG), such as OX40L, for use as a cancer immunotherapeutic (MYXVΔM31R-OX40L). In some embodiments, the myxoma virus is derived from strain Lausanne (given by, e.g., GenBank Accession No. AF170726.2). In some embodiments, the M31R gene of the myxoma virus, through homologous recombination techniques, is engineered to contain a disruption comprising a heterologous nucleic acid sequence comprising one or more expression cassettes, which result in a M31R knockout such that the M31R gene is not expressed, expressed at levels so low as to have no effect, or the expressed protein is non-functional (e.g., is a null-mutation). In some embodiments, the ΔM31R mutant includes a heterologous nucleic acid sequence in place of all or a majority of the M31R gene sequence. For example, in some embodiments, the nucleic acid sequence corresponding to the position of M31R in the MYXV genome (e.g., position 30,138 to 31,319 of the myxoma genome) is replaced with a heterologous nucleic acid sequence comprising an open reading frame that encodes a specific gene of interest (SG), such as human OX40L, resulting in MYXVΔM31R-OX40L. In some embodiments, the expression cassette comprises a single open reading frame that encodes hFlt3L, resulting in MYXVΔM31R-hFlt3L.

Additionally or alternatively, in some embodiments, MYXVΔM31R is engineered to express both OX40L and hFlt3L. In some embodiments, the thymidine kinase (TK) gene of the myxoma virus (e.g., position 57,797 to 58,333 of the myxoma genome), through homologous recombination, is engineered to contain a disruption comprising a heterologous nucleic acid sequence comprising one or more expression cassettes, which results in a TK gene knockout such that the TK gene is not expressed, expressed at levels so low as to have no effect, or the expressed protein is non-functional (e.g., is a null-mutation). The resulting MYXVΔM31R-TK(−) virus is further engineered to comprise one or more expression cassettes that are flanked by a partial sequence of the TK gene (TK-L and TK-R) on either side. In some embodiments, the expression cassette comprises a single open reading frame that encodes a specific gene of interest (SG), such as OX40L using the vaccinia viral synthetic early and late promoter (PsE/L), resulting in MYXVΔM31R-TK(−)-OX40L. In some embodiments, the recombinant virus is further modified at the M31R locus, through homologous recombination techniques, to contain a disruption comprising a heterologous nucleic acid sequence comprising one or more expression cassettes, which result in a M31R knockout such that the M31R gene is not expressed, expressed at levels so low as to have no effect, or the expressed protein is non-functional (e.g., is a null-mutation). In some embodiments, the expression cassette comprises a single open reading frame that encodes a specific gene of interest (SG), such as hFlt3L, resulting in MYXVΔM31R-hFlt3L-TK(−)-OX40L. In some embodiments, the expression cassette encoding OX40L is inserted into the M31R locus while the expression cassette encoding hFlt3L is inserted into the TK locus. In some embodiments, a MYXVΔM31R-anti-CTLA-4-hFlt3L-TK(−) virus is further modified to encode OX40L, resulting in MYXVΔM31R-anti-CTLA-4-TK(−)-hFlt3L-OX40L. In some embodiments, the MYXVΔM31R-anti-CTLA-4-TK(−)-hFlt3L-OX40L virus is further modified to express hIL-12, resulting in MYXVΔM31R-anti-CTLA-4-TK(−)-hFlt3L-OX40L-hIL-12.

In some embodiments, the genetically engineered or recombinant MYXVΔM31R viruses described above are modified to express at least one heterologous gene, such as any one or more of hOX40L, hFlt3L, hIL-2, hIL-12, hIL-15, hIL-15/IL-15RΔ, hIL-18, hIL-21, anti-huCTLA-4, anti-huPD-1, anti-huPD-L1, GITRL, 4-1BBL, or CD40L, and/or include at least one other viral gene mutation or deletion, such as any one or more of the following deletions: E3L (ΔE3L); E3LΔ83N; C7 (ΔC7L); B2R (ΔB2R), B19R (B18R; ΔWR200); E5R; K7R; C12L (IL18BP); B8R; B14R; N1L; C11R; K1L; M1L; N2L; and/or WR199. In other embodiments, no further heterologous genes are added other than those provided in the name of the virus herein (e.g., OX40L or OX40L and hFlt3L), and/or no further viral genes other than M31R or M31R and TK are disrupted or deleted.

Although in certain embodiments described above, the transgene may be inserted into the TK locus, splitting the TK gene and obliterating it, other suitable integration loci can be selected. For example, MYXV encodes several immune modulatory genes, including but not limited to C7, C11, K3, F1, F2, F4, F6, F8, F9, F11, F14.5, J2, A46, E3L, B18R (WR200), E5R, K7R, C12L, B8R, B14R, N1L, C11R, K1L, C16, M1L, N2L, and WR199. Accordingly, in some embodiments, these genes can be deleted to potentially enhance immune activating properties of the virus and allow insertion of transgenes.

Additionally or alternatively, in some embodiments, the heterologous nucleic acid sequence comprises an expression cassette comprising two or more open reading frames encoding two or more specific genes of interest, separated by a nucleotide sequence that encodes, in the 5' to 3' direction, a protease cleavage site (e.g., a furin cleavage site) and a 2A peptide (Pep2A) sequence. For example, in some embodiments, MYXVΔM31R encompasses a recombinant MYXV in which all or a majority of the M31R gene sequence is replaced by a first specific gene of interest (e.g., hFtl3L) and a second specific gene of interest (e.g., OX40L), wherein the coding sequences of the first and second specific genes of interest are separated by a cassette including a furin cleavage site followed by a 2A peptide (Pep2A) sequence, thereby forming a recombinant virus such as MYXVΔM31R-hFlt3L-OX40L.

In some embodiments, the heterologous nucleotide sequence further comprises an additional expression cassette comprising an open reading frame that encodes a selectable marker operably linked to a promoter that is capable of directing expression of the selectable marker. In some embodiments, the selectable marker is a xanthine-guanine phosphoribosyl transferase (gpt) gene. In some embodiments, the selectable marker is a green fluorescent protein (GFP) gene. In some embodiments, the selectable marker is an mCherry gene encoding a red fluorescent protein.

MYXVΔM63R and MYXVΔM64R

The disclosure of the present technology relates to an M63R mutant myxoma virus (i.e., MYXVΔM63R; MYXV comprising an M63R deletion; MYXV genetically engineered to comprise a mutant M63R gene), and an M64R mutant myxoma virus (i.e., MYXVΔM64R, MYXV comprising an M64R deletion; MYXV genetically engineered to comprise a mutant M64R gene), or immunogenic compositions comprising the viruses, and its use as a cancer immunotherapeutic. In some embodiments, the M63R or M64R mutants are inserted into a MYXVΔM127 mCherry genome (see, e.g., FIG. 170). In some embodiments, the MYXVΔM63R or MYXVΔM64R virus is engineered to express one or more specific genes of interest (SG), such as those disclosed herein, for use as a cancer immunotherapeutic. In some embodiments, the myxoma virus is derived from strain Lausanne (given by, e.g., GenBank Accession No. AF170726.2). In some embodiments, the M63R or M64R gene of the myxoma virus, through homologous recombination techniques, is engineered to contain a disruption comprising a heterologous nucleic acid sequence comprising one or more expression cassettes, which result in a M63R or M64R knockout such that the M63R or M64R gene is not expressed, expressed at levels so low as to have no effect, or the expressed protein is non-functional (e.g., is a null-mutation). In some embodiments, the ΔM63R or ΔM64R mutant includes a heterologous nucleic acid sequence (e.g., a heterologous nucleic acid sequence comprising an open reading frome that encodes a specific gene of interest (SG)).

In some embodiments, the genetically engineered or recombinant MYXVΔM63R or MYXVΔM64R viruses described above are modified to express at least one heterologous gene, such as any one or more of hOX40L, hFlt3L, hIL-2, hIL-12, hIL-15, hIL-15/IL-15Rα, hIL-18, hIL-21, anti-huCTLA-4, anti-huPD-1, anti-huPD-L1, GITRL, 4-1BBL, or CD40L, and/or include at least one other viral gene mutation or deletion, such as any one or more of the following deletions: E3L (ΔE3L); E3LΔ83N; C7 (ΔC7L); B2R (ΔB2R), B19R (B18R; ΔWR200); E5R; K7R; C12L (IL18BP); B8R; B14R; N1L; C11R; K1L; M1L; N2L; and/or WR199. In other embodiments, no further heterologous genes are added other than those provided in the name of the virus herein, and/or no further viral genes other than M63R or M64R are disrupted or deleted.

In some embodiments, the heterologous nucleotide sequence further comprises an additional expression cassette comprising an open reading frame that encodes a selectable marker operably linked to a promoter that is capable of directing expression of the selectable marker. In some embodiments, the selectable marker is a xanthine-guanine phosphoribosyl transferase (gpt) gene. In some embodiments, the selectable marker is a green fluorescent protein (GFP) gene. In some embodiments, the selectable marker is an mCherry gene encoding a red fluorescent protein.

Non-limiting examples of a MVAΔ63R and MVAΔ64R construct open reading frames according to the present technology are shown in SEQ ID NOs: 39 and 40 (Table 9).

TABLE 9

| Exemplary nucleotide sequence for the open reading frames of the recombinant MVAΔ63R and MVAΔ64R constructs of the present technology. |
|---|
| pUC57-dM63-GFP plasmid nucleic acid sequence (SEQ ID NO: 40)<br>TCGCGCGTTTCGGTGATGACGGTGAAAACCTCTGACACATGCAGCTCCCGGAGACGGTCACAGC<br>TTGTCTGTAAGCGGATGCCGGGAGCAGACAAGCCCGTCAGGGCGCGTCAGCGGGTGTTGGCGG<br>GTGTCGGGGCTGGCTTAACTATGCGGCATCAGAGCAGATTGTACTGAGAGTGCACCATATGCGG<br>TGTGAAATACCGCACAGATGCGTAAGGAGAAAATACCGCATCAGGCGCCATTCGCCATTCAGG<br>CTGCGCAACTGTTGGGAAGGGCGATCGGTGCGGGCCTCTTCGCTATTACGCCAGCTGGCGAAAG<br>GGGGATGTGCTGCAAGGCGATTAAGTTGGGTAACGCCAGGGTTTTCCCAGTCACGACGTTGTAA<br>AACGACGGCCAGTGAATTCGAGCTCGGTACCCATCAAAATAAAATTGGATAAGGAAAAGACGT<br>TCAAATTCGTCATCGTATTGGAACCGGAGTGGATAGATGAGATAAAACCTATATACATGAAAGT |

TABLE 9-continued

| Exemplary nucleotide sequence for the open reading frames of the recombinant MVAΔ63R and MVAΔ64R constructs of the present technology. |
|---|
| TAACGACGAGTCGGTGGAGTTAGAATTAGACTATAAAGACGCCATCAAACGCATCTATTCGGCG |
| GAGGTGGTATTATGTTCAGATTCCGTGATCAACCTGTTCAGTGACGTCGACGTGTCTTATACGTG |
| CGAATACCCTACGATTAAGGTGAATACGATAAAAAAATACTACAGCGTACAGAACAGAGGGAT |
| GACCTACGTACATATAGAATCGCCCATTAATACGAAAGATAAATGCTGGTTCGTGGAAAAGAAC |
| GGATGGTACGAGGATAGAACACATTCGTAATTTTTTTATATAGTGAAAAATAATGTGAGCATTA |
| CGAGCGTGGGTTTATCTACACGGCTAGCAAAAATTGAAATTTTATTTTTTTTTTTTGGAATATAA |
| ATAAGCTCGAAGTCGACAGATCTAGGCCTGGTACCATGGTGAGCAAGGGCGAGGAGCTGTTCA |
| CCGGGGTGGTGCCCATCCTGGTCGAGCTGGACGGCGACGTAAACGGCCACAAGTTCAGCGTGTC |
| CGGCGAGGGCGAGGGCGATGCCACCTACGGCAAGCTGACCCTGAAGTTCATCTGCACCACCGG |
| CAAGCTGCCCGTGCCCTGGCCCACCCTCGTGACCACCCTGACCTACGGCGTGCAGTGCTTCAGC |
| CGCTACCCCGACCACATGAAGCAGCACGACTTCTTCAAGTCCGCCATGCCCGAAGGCTACGTCC |
| AGGAGCGCACCATCTTCTTCAAGGACGACGGCAACTACAAGACCCGCGCCGAGGTGAAGTTCG |
| AGGGCGACACCCTGGTGAACCGCATCGAGCTGAAGGGCATCGACTTCAAGGAGGACGGCAACA |
| TCCTGGGGCACAAGCTGGAGTACAACTACAACAGCCACAACGTCTATATCATGGCCGACAAGC |
| AGAAGAACGGCATCAAGGTGAACTTCAAGATCCGCCACAACATCGAGGACGGCAGCGTGCAGC |
| TCGCCGACCACTACCAGCAGAACACCCCCATCGGCGACGGCCCCGTGCTGCTGCCCGACAACCA |
| CTACCTGAGCACCCAGTCCGCCCTGAGCAAAGACCCCAACGAGAAGCGCGATCACATGGTCCT |
| GCTGGAGTTCGTGACCGCCGCCGGGATCACTCTCGGCATGGACGAGCTGTACAAGTAAAGCTAG |
| CGATCAGGCCTTTTTTTTTATTGAAAAATAATAGTAAGAAAACGTTGCCGTAAACATGGAGGAG |
| GGTATCGTGCATAAATTAGACGTGTTTCTCATCGACGAAAACGTGTCTATAAAACACGTTAATTT |
| GTTCGACGGGGATAGTTACGGGTGCAACATCCATTTAAAGACCGCCACGTGTAAGTACATCACC |
| TTTATATTAGTCTTAGAACCCGATTGGGAGAACATAGTCGAGGCAAAACCCATTCACATGAGAT |
| TGAACGGCAAAAAGATACGCGTACCACTCGTAGCAAAAACCCACACGTCACTTATTTATAAAGT |
| CGTTATCTACGTGGAGGAAGACGCCCTCGCACGATTCTACAGCGACGTGGAAAGGTCGTACACG |
| GACGTGTATCCCACGTTTCTAGTCAATACGGATACGCGACGTTATTACATTTTGGATAGCGGAC |
| GGACGTATACGTACATAGATCCGTTTATATCGGACGAAGCTTGGCGTAATCATGGTCATAGCTG |
| TTTCCTGTGTGAAATTGTTATCCGCTCACAATTCCACACAACATACGAGCCGGAAGCATAAAGT |
| GTAAAGCCTGGGGTGCCTAATGAGTGAGCTAACTCACATTAATTGCGTTGCGCTCACTGCCCGC |
| TTTCCAGTCGGGAAACCTGTCGTGCCAGCTGCATTAATGAATCGGCCAACGCGCGGGGAGAGGC |
| GGTTTGCGTATTGGGCGCTCTTCCGCTTCCTCGCTCACTGACTCGCTGCGCTCGGTCGTTCGGCT |
| GCGGCGAGCGGTATCAGCTCACTCAAAGGCGGTAATACGGTTATCCACAGAATCAGGGGATAA |
| CGCAGGAAAGAACATGTGAGCAAAAGGCCAGCAAAAGGCCAGGAACCGTAAAAAGGCCGCGT |
| TGCTGGCGTTTTTCCATAGGCTCCGCCCCCCTGACGAGCATCACAAAAATCGACGCTCAAGTCA |
| GAGGTGGCGAAACCCGACAGGACTATAAAGATACCAGGCGTTTCCCCCTGGAAGCTCCCTCGTG |
| CGCTCTCCTGTTCCGACCCTGCCGCTTACCGGATACCTGTCCGCCTTTCTCCCTTCGGGAAGCGT |
| GGCGCTTTCTCATAGCTCACGCTGTAGGTATCTCAGTTCGGTGTAGGTCGTTCGCTCCAAGCTGG |
| GCTGTGTGCACGAACCCCCCGTTCAGCCCGACCGCTGCGCCTTATCCGGTAACTATCGTCTTGAG |
| TCCAACCCGGTAAGACACGACTTATCGCCACTGGCAGCAGCCACTGGTAACAGGATTAGCAGA |

TABLE 9-continued

| Exemplary nucleotide sequence for the open reading frames of the recombinant MVAΔ63R and MVAΔ64R constructs of the present technology. |
|---|

GCGAGGTATGTAGGCGGTGCTACAGAGTTCTTGAAGTGGTGGCCTAACTACGGCTACACTAGAA

GAACAGTATTTGGTATCTGCGCTCTGCTGAAGCCAGTTACCTTCGGAAAAAGAGTTGGTAGCTC

TTGATCCGGCAAACAAACCACCGCTGGTAGCGGTGGTTTTTTTGTTTGCAAGCAGCAGATTACG

CGCAGAAAAAAAGGATCTCAAGAAGATCCTTTGATCTTTTCTACGGGGTCTGACGCTCAGTGGA

ACGAAAACTCACGTTAAGGGATTTTGGTCATGAGATTATCAAAAAGGATCTTCACCTAGATCCT

TTTAAATTAAAAATGAAGTTTTAAATCAATCTAAAGTATATATGAGTAAACTTGGTCTGACAGTT

ACCAATGCTTAATCAGTGAGGCACCTATCTCAGCGATCTGTCTATTTCGTTCATCCATAGTTGCC

TGACTCCCCGTCGTGTAGATAACTACGATACGGGAGGGCTTACCATCTGGCCCCAGTGCTGCAA

TGATACCGCGAGACCCACGCTCACCGGCTCCAGATTTATCAGCAATAAACCAGCCAGCCGGAA

GGGCCGAGCGCAGAAGTGGTCCTGCAACTTTATCCGCCTCCATCCAGTCTATTAATTGTTGCCGG

GAAGCTAGAGTAAGTAGTTCGCCAGTTAATAGTTTGCGCAACGTTGTTGCCATTGCTACAGGCA

TCGTGGTGTCACGCTCGTCGTTTGGTATGGCTTCATTCAGCTCCGGTTCCCAACGATCAAGGCGA

GTTACATGATCCCCCATGTTGTGCAAAAAAGCGGTTAGCTCCTTCGGTCCTCCGATCGTTGTCAG

AAGTAAGTTGGCCGCAGTGTTATCACTCATGGTTATGGCAGCACTGCATAATTCTCTTACTGTCA

TGCCATCCGTAAGATGCTTTTCTGTGACTGGTGAGTACTCAACCAAGTCATTCTGAGAATAGTGT

ATGCGGCGACCGAGTTGCTCTTGCCCGGCGTCAATACGGGATAATACCGCGCCACATAGCAGAA

CTTTAAAAGTGCTCATCATTGGAAAACGTTCTTCGGGGCGAAAACTCTCAAGGATCTTACCGCT

GTTGAGATCCAGTTCGATGTAACCCACTCGTGCACCCAACTGATCTTCAGCATCTTTTACTTTCA

CCAGCGTTTCTGGGTGAGCAAAAACAGGAAGGCAAAATGCCGCAAAAAAGGGAATAAGGGCG

ACACGGAAATGTTGAATACTCATACTCTTCCTTTTTCAATATTATTGAAGCATTTATCAGGGTTA

TTGTCTCATGAGCGGATACATATTTGAATGTATTTAGAAAAATAAACAAATAGGGGTTCCGCGC

ACATTTCCCCGAAAAGTGCCACCTGACGTCTAAGAAACCATTATTATCATGACATTAACCTATA

AAAATAGGCGTATCACGAGGCCCTTTCGTC pUC57-dM64-GFP plasmid nucleic acid sequence (SEQ ID NO: 41)

TCGCGCGTTTCGGTGATGACGGTGAAAACCTCTGACACATGCAGCTCCCGGAGACGGTCACAGC

TTGTCTGTAAGCGGATGCCGGGAGCAGACAAGCCCGTCAGGGCGCGTCAGCGGGTGTTGGCGG

GTGTCGGGGCTGGCTTAACTATGCGGCATCAGAGCAGATTGTACTGAGAGTGCACCATATGCGG

TGTGAAATACCGCACAGATGCGTAAGGAGAAAATACCGCATCAGGCGCCATTCGCCATTCAGG

CTGCGCAACTGTTGGGAAGGGCGATCGGTGCGGGCCTCTTCGCTATTACGCCAGCTGGCGAAAG

GGGGATGTGCTGCAAGGCGATTAAGTTGGGTAACGCCAGGGTTTTCCCAGTCACGACGTTGTAA

AACGACGGCCAGTGAATTCGAGCTCGGTACCATGGAACTGATAAAATCTTTACACACGTCCACG

GACTTAACGGTCTACAGAACATCAATGCTCCATCACCGTAATATGCCCGAGAAGGAGTACTGCT

TCACGCAGATATACTCGGCTACGTTAAACATAGACACCAAGTCGACCGTCAGTTTTCGTAGTAC

GATACACGACGGGTTTCTTTCGACGTATCCGACGATCTACATTAATCCGGAGGAAAAATATTAC

AAAGTCCAGAACAAAGGACGTCTGCGGATGCGGGTGGTTACACCTATCTTAAACAGCGACAAA

CTACAGTTCATGGATAAGGGCGAGATGTATGCGGGTGTCGGCGACGACCCATCGATCGTAGACA

GTAGCGATAGCGACGATTATACCAGCAGTGAGGAAGACACGGAGGAGGAAGACACGGAGGAG

GAAGAAGATTGATTTTTTTTATTGAAAAATAATAGTAAGAAAACGTTGCCGTAAACGCTAGCAA

TABLE 9-continued

| Exemplary nucleotide sequence for the open reading frames of the recombinant MVAΔ63R and MVAΔ64R constructs of the present technology. |
|---|
| AAATTGAAATTTTATTTTTTTTTTTTGGAATATAAATAAGCTCGAAGTCGACAGATCTAGGCCTG |
| GTACCATGGTGAGCAAGGGCGAGGAGCTGTTCACCGGGGTGGTGCCCATCCTGGTCGAGCTGG |
| ACGGCGACGTAAACGGCCACAAGTTCAGCGTGTCCGGCGAGGGCGAGGGCGATGCCACCTACG |
| GCAAGCTGACCCTGAAGTTCATCTGCACCACCGGCAAGCTGCCCGTGCCCTGGCCCACCCTCGT |
| GACCACCCTGACCTACGGCGTGCAGTGCTTCAGCCGCTACCCCGACCACATGAAGCAGCACGAC |
| TTCTTCAAGTCCGCCATGCCCGAAGGCTACGTCCAGGAGCGCACCATCTTCTTCAAGGACGACG |
| GCAACTACAAGACCCGCGCCGAGGTGAAGTTCGAGGGCGACACCCTGGTGAACCGCATCGAGC |
| TGAAGGGCATCGACTTCAAGGAGGACGGCAACATCCTGGGGCACAAGCTGGAGTACAACTACA |
| ACAGCCACAACGTCTATATCATGGCCGACAAGCAGAAGAACGGCATCAAGGTGAACTTCAAGA |
| TCCGCCACAACATCGAGGACGGCAGCGTGCAGCTCGCCGACCACTACCAGCAGAACACCCCCA |
| TCGGCGACGGCCCCGTGCTGCTGCCCGACAACCACTACCTGAGCACCCAGTCCGCCCTGAGCAA |
| AGACCCCAACGAGAAGCGCGATCACATGGTCCTGCTGGAGTTCGTGACCGCCGCCGGGATCACT |
| CTCGGCATGGACGAGCTGTACAAGTAAAGCTAGCGATCAGGCCTGTTTTTATTATAATGATTTTT |
| AAATTTAAACGTTATTAAAAATGGAACCGGTATCTATGGACAAACCCTTTATGTACTTCGATGA |
| AATAGACGATGAATTAGAGTATGAACCCGAAAGCGTTAACGAAACACCTAAAAAACTCCCCCA |
| CCAGGGGCAGTTGAAATTATTGCTAGGCGAGTTGTTTTTTCTAAGTAAATTACAACGCCACGGC |
| ATTTTAGACGGATCCACGATCGTGTATATAGGATCCGCTCCCGGCACCCACATCAAATACTTAC |
| GCGATCATTTTATGTCTATGGGATTGGTTATTAAATGGATGTTGATCGACGGACGCACGCACGA |
| TCCCATCCTTGAAGGATTACGCGACGTAATTCTCATTACCAAGTTCGTCGACGAGGCGTACATTC |
| GACAGTTGAAGAAACAACTGTATCCGTCTAGGGTTATTCTCATTTCGGACGTGCGCTCGAAACG |
| GGGACAGAAAAGCTTGGCGTAATCATGGTCATAGCTGTTTCCTGTGTGAAATTGTTATCCGCTC |
| ACAATTCCACACAACATACGAGCCGGAAGCATAAAGTGTAAAGCCTGGGGTGCCTAATGAGTG |
| AGCTAACTCACATTAATTGCGTTGCGCTCACTGCCCGCTTTCCAGTCGGGAAACCTGTCGTGCCA |
| GCTGCATTAATGAATCGGCCAACGCGCGGGGAGAGGCGGTTTGCGTATTGGGCGCTCTTCCGCT |
| TCCTCGCTCACTGACTCGCTGCGCTCGGTCGTTCGGCTGCGGCGAGCGGTATCAGCTCACTCAA |
| AGGCGGTAATACGGTTATCCACAGAATCAGGGGATAACGCAGGAAAGAACATGTGAGCAAAAG |
| GCCAGCAAAAGGCCAGGAACCGTAAAAAGGCCGCGTTGCTGGCGTTTTTCCATAGGCTCCGCCC |
| CCCTGACGAGCATCACAAAAATCGACGCTCAAGTCAGAGGTGGCGAAACCCGACAGGACTATA |
| AAGATACCAGGCGTTTCCCCCTGGAAGCTCCCTCGTGCGCTCTCCTGTTCCGACCCTGCCGCTTA |
| CCGGATACCTGTCCGCCTTTCTCCCTTCGGGAAGCGTGGCGCTTTCTCATAGCTCACGCTGTAGG |
| TATCTCAGTTCGGTGTAGGTCGTTCGCTCCAAGCTGGGCTGTGTGCACGAACCCCCCGTTCAGCC |
| CGACCGCTGCGCCTTATCCGGTAACTATCGTCTTGAGTCCAACCCGGTAAGACACGACTTATCG |
| CCACTGGCAGCAGCCACTGGTAACAGGATTAGCAGAGCGAGGTATGTAGGCGGTGCTACAGAG |
| TTCTTGAAGTGGTGGCCTAACTACGGCTACACTAGAAGAACAGTATTTGGTATCTGCGCTCTGCT |
| GAAGCCAGTTACCTTCGGAAAAAGAGTTGGTAGCTCTTGATCCGGCAAACAAACCACCGCTGGT |
| AGCGGTGGTTTTTTTGTTTGCAAGCAGCAGATTACGCGCAGAAAAAAAGGATCTCAAGAAGATC |
| CTTTGATCTTTTCTACGGGGTCTGACGCTCAGTGGAACGAAAACTCACGTTAAGGGATTTTGGTC |
| ATGAGATTATCAAAAAGGATCTTCACCTAGATCCTTTTAAATTAAAAATGAAGTTTTAAATCAA |

TABLE 9-continued

| Exemplary nucleotide sequence for the open reading frames of the recombinant MVAΔ63R and MVAΔ64R constructs of the present technology. |
|---|
| TCTAAAGTATATATGAGTAAACTTGGTCTGACAGTTACCAATGCTTAATCAGTGAGGCACCTAT |
| CTCAGCGATCTGTCTATTTCGTTCATCCATAGTTGCCTGACTCCCCGTCGTGTAGATAACTACGA |
| TACGGGAGGGCTTACCATCTGGCCCCAGTGCTGCAATGATACCGCGAGACCCACGCTCACCGGC |
| TCCAGATTTATCAGCAATAAACCAGCCAGCCGGAAGGGCCGAGCGCAGAAGTGGTCCTGCAAC |
| TTTATCCGCCTCCATCCAGTCTATTAATTGTTGCCGGGAAGCTAGAGTAAGTAGTTCGCCAGTTA |
| ATAGTTTGCGCAACGTTGTTGCCATTGCTACAGGCATCGTGGTGTCACGCTCGTCGTTTGGTATG |
| GCTTCATTCAGCTCCGGTTCCCAACGATCAAGGCGAGTTACATGATCCCCCATGTTGTGCAAAA |
| AAGCGGTTAGCTCCTTCGGTCCTCCGATCGTTGTCAGAAGTAAGTTGGCCGCAGTGTTATCACTC |
| ATGGTTATGGCAGCACTGCATAATTCTCTTACTGTCATGCCATCCGTAAGATGCTTTTCTGTGAC |
| TGGTGAGTACTCAACCAAGTCATTCTGAGAATAGTGTATGCGGCGACCGAGTTGCTCTTGCCCG |
| GCGTCAATACGGGATAATACCGCGCCACATAGCAGAACTTTAAAAGTGCTCATCATTGGAAAAC |
| GTTCTTCGGGGCGAAAACTCTCAAGGATCTTACCGCTGTTGAGATCCAGTTCGATGTAACCCACT |
| CGTGCACCCAACTGATCTTCAGCATCTTTTACTTTCACCAGCGTTTCTGGGTGAGCAAAAACAGG |
| AAGGCAAAATGCCGCAAAAAAGGGAATAAGGGCGACACGGAAATGTTGAATACTCATACTCTT |
| CCTTTTTCAATATTATTGAAGCATTTATCAGGGTTATTGTCTCATGAGCGGATACATATTTGAAT |
| GTATTTAGAAAAATAAACAAATAGGGGTTCCGCGCACATTTCCCCGAAAAGTGCCACCTGACGT |
| CTAAGAAACCATTATTATCATGACATTAACCTATAAAAATAGGCGTATCACGAGGCCCTTTCGT |
| C |

XI. Melanoma

Melanoma, one of the deadliest cancers, is the fastest growing cancer in the U.S. and worldwide. In most cases, advanced melanoma is resistant to conventional therapies, including chemotherapy and radiation. As a result, people with metastatic melanoma have a very poor prognosis, with a life expectancy of only 6 to 10 months. The discovery that about 50% of melanomas have mutations in BRAF (a key tumor-promoting gene) opened the door for targeted therapy of this disease. Early clinical trials with BRAF inhibitors showed remarkable, but unfortunately not sustainable, responses in patients with melanomas with BRAF mutations. Therefore, alternative treatment strategies for these patients, as well as others with melanoma without BRAF mutations, are urgently needed.

Human pathological data indicate that the presence of T-cell infiltrates within melanoma lesions correlates positively with longer patient survival (Oble et al., *Cancer Immun.* 9:3 (2009)). The importance of the immune system in protection against melanoma is further supported by partial success of immunotherapies, such as the immune activators IFN-α2b and IL-2 (Lacy et al., *Expert Rev. Dermatol.* 7(1):51-68 (2012)) as well as the unprecedented clinical responses of patients with metastatic melanoma to immune checkpoint therapy, including anti-CTLA-4 and anti-PD-1/PD-L1 as an agent alone or in combination therapy (Sharma & Allison, *Science* 348(6230)" 56-61 (2015); Hodi et al., *NEJM* 363(8):711-723 (2010); Wolchok et al., *Lancet Oncol.* 11(6):155-164 (2010); Topalian et al., *NEJM* 366(26):2443-2454 (2012); Wolchok et al., *NEJM* 369(2):122-133 (2013); Hamid et al., *NEJM* 369(2):134-144 (2013); Tumeh et al., *Nature* 515(7528):568-571 (2014)). However, many patients fail to respond to immune checkpoint blockade therapy alone.

XII. Type I IFN and the Cytosolic DNA-Sensing Pathway in Tumor Immunity

Type I IFN plays important roles in host antitumor immunity (Fuertes et al., *Trends Immunol.* 34:67-73 (2013)). IFNAR1-deficent mice are more susceptible to developing tumors after implantation of tumor cells; spontaneous tumor-specific T-cell priming is also defective in IFNAR1-deficient mice (Diamond et al., *J. Exp. Med.* 208:1989-2003 (2011); Fuertes et al., *J. Exp. Med.* 208:2005-2016 (2011)). More recent studies have shown that the cytosolic DNA-sensing pathway is important in the innate immune sensing of tumor-derived DNA, which leads to the development of antitumor $CD8^+$ T-cell immunity (Woo et al., *Immunity* 41:830-842 (2014)). This pathway also plays a role in radiation-induced antitumor immunity (Deng et al., *Immunity* 4:843-852 (2014)). Although spontaneous anti-tumor T-cell responses can be detected in patients with cancers, cancers eventually overcome host antitumor immunity in most patients. Novel strategies to alter the tumor immune suppressive microenvironment would be beneficial for cancer therapy.

XIII. Immune Response

In addition to induction of the immune response by up-regulation of particular immune system activities (such as antibody and/or cytokine production, or activation of cell mediated immunity), immune responses may also include suppression, attenuation, or any other down-regulation of detectable immunity, so as to reestablish homeostasis and prevent excessive damage to the host's own organs and tissues. In some embodiments, an immune response that is induced according to the methods of the present disclosure generates effector T-cells (e.g., helper, killer, regulatory T-cells). In some embodiments, an immune response that is induced according to the methods of the present disclosure generates effector $CD8^+$ (antitumor cytotoxic $CD8^+$) T-cells or activated T helper ($T_H$) cells (e.g., effector $CD4^+$ T-cells), or both that can bring about directly or indirectly the death, or loss of the ability to propagate, of a tumor cell.

Induction of an immune response by the compositions and methods of the present disclosure may be determined by detecting any of a variety of well-known immunological parameters (Takaoka et al., *Cancer Sci.* 94:405-11 (2003); Nagorsen et al., *Crit. Rev. Immunol.* 22:449-62 (2002)). Induction of an immune response may therefore be established by any of a number of well-known assays, including immunological assays. Such assays include, but need not be limited to, in vivo, ex vivo, or in vitro determination of soluble immunoglobulins or antibodies; soluble mediators such as cytokines, chemokines, hormones, growth factors and the like as well as other soluble small peptide, carbohydrate, nucleotide and/or lipid mediators; cellular activation state changes as determined by altered functional or structural properties of cells of the immune system, for example cell proliferation, altered motility, altered intracellular cation gradient or concentration (such as calcium); phosphorylation or dephosphorylation of cellular polypeptides; induction of specialized activities such as specific gene expression or cytolytic behavior; cellular differentiation by cells of the immune system, including altered surface antigen expression profiles, or the onset of apoptosis (programmed cell death); or any other criterion by which the presence of an immune response may be detected. For example, cell surface markers that distinguish immune cell types may be detected by specific antibodies that bind to $CD4^+$, $CD8^+$, or NK cells. Other markers and cellular components that can be detected include but are not limited to interferon γ (IFN-γ), tumor necrosis factor (TNF), IFN-α, IFN-β (IFNB), IL-6, and CCL5. Common methods for detecting the immune response include, but are not limited to, flow cytometry, ELISA, immunohistochemistry. Procedures for performing these and similar assays are widely known and may be found, for example in Letkovits (Immunology Methods Manual: The Comprehensive Sourcebook of Techniques, Current Protocols in Immunology, 1998).

XIV. Pharmaceutical Compositions and Preparations of the Present Technology

Disclosed herein are pharmaceutical compositions comprising MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3L-ΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 that may contain a carrier or diluent, which can be a solvent or dispersion medium containing, for example, water, saline, Tris buffer, polyol (for example, glycerol, propylene glycol, and liquid polyethylene glycol, and the like), suitable mixtures thereof, and vegetable oils. The proper fluidity can be maintained, for example, by the use of a coating such as lecithin, by the maintenance of the required particle size in the case of dispersion and by the use of surfactants. Prevention of the action of microorganisms can be effected by various antibacterial and antifungal agents and preservatives, for example, parabens, chlorobutanol, phenol, sorbic acid, thimerosal, and the like. In some embodiments, isotonic agents, for example, sugars or sodium chloride, and buffering agents are included. Prolonged absorption of the injectable compositions can be brought about by the use in the compositions of agents delaying absorption, for example, aluminum monostearate and gelatin or carrier molecules. Other excipients may include wetting or emulsifying agents. In general, excipients suitable for injectable preparations can be included as apparent to those skilled in the art.

Pharmaceutical compositions and preparations comprising MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3-LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4- ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63R-ΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔ-M31R-hFlt3L-OX40L-IL-12-IL-15/IL-15Rα, MYXVΔ-M62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 may be manufactured by means of conventional mixing, dissolving, granulating, emulsifying, encapsulating, entrapping or lyophilizing processes. Pharmaceutical viral compositions may be formulated in conventional manner using one or more physiologically acceptable carriers, diluents, excipients or auxiliaries that facilitate formulating virus preparations suitable for in vitro, in vivo, or ex vivo use. The compositions can be combined with one or more additional biologically active agents and may be formulated with a pharmaceutically acceptable carrier, diluent or excipient to generate pharmaceutical (including biologic) or veterinary compositions of the instant disclosure suitable for parenteral or intratumoral administration.

Many types of formulation are possible as is appreciated by those skilled in the art. The particular type chosen is dependent upon the route of administration chosen, as is well-recognized in the art. For example, systemic formulations will generally be designed for administration by injection, e.g., intravenous, as well as those designed for intratumoral delivery. In some embodiments, the systemic or intratumoral formulation is sterile.

Sterile injectable solutions are prepared by incorporating MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3-LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔ-M64R-hFlt3L-OX40L, MYXVΔM62RΔM63RΔM64RΔM31R-hFlt3L-OX40L, MYXVΔM62RΔM63RΔM64-RΔM31R-hFlt3L-OX40L-IL-12, MYXVΔM62RΔM63-RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔ-M62RΔM63RΔM64RΔM31R-hFlt3L-OX40L-IL-12-IL-15/IL-15Rα-anti-CTLA-4 in the required amount of the appropriate solvent with various other ingredients enumerated herein, as required, followed by suitable sterilization means. Generally, dispersions are prepared by incorporating the various sterilized active ingredients into a sterile vehicle that contains the basic dispersion medium and the required other ingredients from those enumerated above. In the case of sterile powders for the preparation of sterile injectable solutions, the preferred methods of preparation are vacuum drying and freeze-drying techniques, which yield a powder of the virus plus any additional desired ingredient from a previously sterile-filtered solution thereof.

In some embodiments, the MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63R-ΔM64R-hFlt3L-OX40L, MYXVΔM62RΔM63RΔM64R-ΔM31R-hFlt3L-OX40L, MYXVΔM62RΔM63RΔM64-RΔM31R-hFlt3L-OX40L-IL-12, MYXVΔM62RΔM63R-ΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 compositions of the present disclosure may be formulated in aqueous solutions, or in physiologically compatible solutions or buffers such as Hanks's solution, Ringer's solution, mannitol solutions or physiological saline buffer. In certain embodiments, any of the MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVA- ΔE5R- hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63R-ΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64R-ΔM31R-hFlt3L-OX40L-IL-12-IL-15/IL-15Rα, MYXVΔ-M62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 compositions may contain formulator agents, such as suspending, stabilizing, penetrating or dispersing agents, buffers, lyoprotectants or preservatives such as polyethylene glycol, polysorbate 80, 1-dodecylhexahydro-2H-azepin-2-one (laurocapran), oleic acid, sodium citrate, Tris HCl, dextrose, propylene glycol, mannitol, polysorbate polyethylenesorbitan monolaurate (Tween®-20), isopropyl myristate, benzyl alcohol, isopropyl alcohol, ethanol sucrose, trehalose and other such generally known in the art may be used in any of the compositions of the instant disclosure. (Pramanick et al., *Pharma Times* 45(3):65-76 (2013)).

The biologic or pharmaceutical compositions of the present disclosure can be formulated to allow the virus contained therein to be available to infect tumor cells upon administration of the composition to a subject. The level of virus in serum, tumors, and if desired other tissues after administration can be monitored by various well-established techniques, such as antibody-based assays (e.g., ELISA, immunohistochemistry, etc.).

The engineered poxviruses of the present technology can be stored at −80° C. with a titer of $3.5\times10^7$ pfu/mL formulated in about 10 mM Tris, 140 mM NaCl pH 7.7. For the preparation of vaccine shots, e.g., $10^2$-$10^8$ or $10^2$-$10^9$ viral particles can be lyophilized in 100 mL of phosphate-buffered saline (PBS) in the presence of 2% peptone and 1% human albumin in an ampoule, preferably a glass ampoule. Alternatively, the injectable preparations can be produced by stepwise freeze-drying of the engineered poxvirus in a formulation. This formulation can contain additional additives such as mannitol, dextran, sugar, glycine, lactose, or polyvinylpyrrolidone or other additives such as antioxidants or inert gas, stabilizers, or recombinant proteins (e.g., human serum albumin) suitable for in vivo administration. The glass ampoule is then sealed and can be stored between 4° C. and room temperature for several months. In some embodiments, the ampoule is stored at temperatures below −20° C.

For therapy, the lyophilisate can be dissolved in an aqueous solution, such as physiological saline or Tris buffer, and administered either systemically or intratumorally. The mode of administration, the dose, and the number of administrations can be optimized by those skilled in the art.

The pharmaceutical composition according to the present disclosure may comprise an additional adjuvant. As used herein, an "adjuvant" refers to a substance that enhances, augments, or potentiates the host's immune response to tumor antigens. A typical adjuvant may be aluminum salts, such as aluminum hydroxide or aluminum phosphate, Quil A, bacterial cell wall peptidoglycans, virus-like particles, polysaccharides, toll-like receptors, nano-beads, etc. (Aguilar et al., *Vaccine* 25:3752-3762 (2007)).

XV. Therapeutic Methods of the Present Technology

In one aspect, the present disclosure provides a method for treating a solid tumor in a subject in need thereof, the method comprising administering to the subject an effective amount of: a recombinant modified vaccinia Ankara (MVA) virus comprising a deletion of E3L (MVAΔE3L) genetically engineered to express OX40L (MVAΔE3L-OX40L); a recombinant MVA virus comprising a deletion of C7L (MVAΔC7L) genetically engineered to express OX40L (MVAΔC7L-OX40L); a recombinant MVAΔC7L engineered to express OX40L and hFlt3L (MVAΔC7L-hFlt3L-OX40L); a recombinant MVA genetically engineered to comprise a deletion of C7L, a deletion of E5R, and to express hFlt3L and OX40L (MVAΔC7LΔE5R-hFlt3L-OX40L); a recombinant MVA genetically engineered to comprise a deletion of E5R (MVAΔE5R); a recombinant MVA genetically engineered to comprise a deletion of E5R and to express hFlt3L and OX40L (MVAΔE5R-hFlt3L-OX40L); a recombinant vaccinia virus comprising a deletion of C7L (VACVΔC7L) genetically engineered to express OX40L (VACVΔC7L-OX40L); a recombinant VACVΔC7L genetically engineered to express both OX40L and hFlt3L (VACVΔC7L-hFlt3L-OX40L); a VACV genetically engineered to comprise a deletion of E5R (VACVΔE5R); a recombinant VACV genetically engineered to comprise a deletion of E5R, a deletion of thymidine kinase (TK), and to express ani-CTLA-4, hFlt3L, and OX40L (VACV-TK$^-$-anti-CTLA-4-ΔE5R-hFlt3L-OX40L); a MYXV genetically engineered to comprise a deletion of M31R (MYXVΔM31R); a recombinant MYXV genetically engineered to comprise a deletion of M31R and to express hFl3L and OX40L (MYXVΔM31R-hFlt3L-OX40L); and/or additional engineered poxviruses selected from MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L- hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, or combinations thereof. In some embodiments, the treatment comprises one or more of the following: inducing an immune response in the subject against the tumor or enhancing or promoting an ongoing immune response against the tumor in the subject, reducing the size of the tumor, eradicating the tumor, inhibiting growth of the tumor, inhibiting metastatic growth of the tumor, inducing apoptosis of tumor cells, or prolonging survival of the subject. In some embodiments, the induction, enhancement, or promotion of the immune response comprises one or more of the following: increased levels of effector T-cells in tumor cells as compared to tumor cells infected with the corresponding MVA, MVAΔE3L, MVAΔC7L, VACV, VACVΔC7L, or MYXV strain; and increased splenic production of effector T-cells as compared to the corresponding MVA, MVAΔE3L, MVAΔC7L, VACV, VACVΔC7L, or MYXV strain. In some embodiments, the subject is a human. In some embodiments, the composition of the present technology comprising MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 is administered to the subject by intratumoral or intravenous injection or a simultaneous (i.e., concurrent) or sequential combination of intratumoral and intravenous injection.

In some embodiments, the subject is diagnosed with a cancer such as melanoma, colon carcinoma, breast cancer, prostate cancer, fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor and other bone tumors (e.g., osteosarcoma, malignant fibrous histiocytoma), leiomyosarcoma, rhabdomyosarcoma, pancreatic cancer, ovarian cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, bladder carcinoma, epithelial carcinoma, brain/CNS tumors (e.g., astrocytoma, glioma, glioblastoma, childhood tumors, such as atypical teratoid/rhabdoid tumor, germ cell tumor, embryonal tumor, ependymoma) medulloblastoma, craniopharyngioma, ependymoma, pinealoma, hemangioblastoma, acoustic neuroma, oligodendroglioma, meningioma, neuroblastoma, retinoblastoma, head-and-neck cancer, rectal adenocarcinoma, glioma, urothelial carcinoma, uterine (e.g., endometrial cancer, fallopian tube cancer) non-small cell lung cancer (squamous and adenocarcinoma), ductal carcinoma in situ, and hepatocellular carcinoma, adrenal tumors (e.g., adrenocortical carcinoma), esophageal cancer, eye cancer (e.g., melanoma, retinoblastoma), gallbladder cancer, gastrointestinal cancer, heart cancer, laryngeal and hypopharyngeal cancer, oral cancer (e.g., lip, mouth, salivary gland), nasopharyngeal cancer, neuroblastoma, peritoneal cancer, pituitary cancer, Kaposi's sarcoma, small intestine cancer, stomach cancer, thymus cancer, thyroid cancer, parathyroid cancer, vaginal tumor, and the metastases of any of the foregoing.

XVI. Combination Therapy with Other Active Agents

In some embodiments, the engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-

OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63RΔ-M64R-hFlt3L-OX40L, MYXVΔM62RΔM63RΔM6-4RΔM31R-hFlt3L-OX40L, MYXVΔM62RΔM63RΔM6-4RΔM31R-hFlt3L-OX40L-IL-12, MYXVΔM62RΔM-63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM6-4RΔM31R-hFlt3L-OX40L-IL-12-IL-15/IL-15Rα-anti-CTLA-4) are combined or separately, sequentially, or simultaneously (i.e., concurrently) administered with any combination of: (i) one or more immune checkpoint blocking agents and/or one or more immune system stimulators; (ii) one or more anti-cancer drugs; and (iii) an immunomodulatory drug (i.e., fingolimod (FTY720)). In some embodiments, the combined administration of the engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63R-ΔM64R-hFlt3L-OX40L, MYXVΔM62RΔM63RΔM64-RΔM31R-hFlt3L-OX40L, MYXVΔM62RΔM63RΔM64-RΔM31R-hFlt3L-OX40L-IL-12, MYXVΔM62RΔM63RΔ-M64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64-RΔM31R-hFlt3L-OX40L-IL-12-IL-15/IL-15Rα-anti-CTLA-4) with any one or more of: (i) one or more immune checkpoint blocking agents and/or one or more immune system stimulators; (ii) one or more anti-cancer drugs; and (iii) an immunomodulatory drug (i.e., fingolimod (FTY720)) results in a synergistic effect with respect to the treatment of solid tumors.

A. Immune Checkpoint Blocking Agents and Immune System Stimulators

In some embodiments, MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63RΔ-M64R-hFlt3L-OX40L, MYXVΔM62RΔM63RΔM64R-ΔM31R-hFlt3L-OX40L, MYXVΔM62RΔM63RΔM64R-ΔM31R-hFlt3L-OX40L-IL-12, MYXVΔM62RΔM63RΔ-M64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4 is combined or separately, sequentially, or simultaneously (i.e., concurrently) administered with one or more immune checkpoint blocking agents and/or one or more immune system stimulators. The one or more immune checkpoint blocking agents may target any one or more of PD-1 (programmed death 1), PD-L1 (programmed death ligand 1), or CTLA-4 (cytotoxic T lymphocyte antigen 4) (e.g., anti-huPD-1, anti-huPD-L1, or anti-huCTLA-4 antibodies).

In some embodiments, the one or more immune checkpoint blocking agents are selected from the group consisting of ipilimumab, nivolumab, pidilizumab, lambrolizumab, pembrolizumab, atezolizumab, avelumab, and durvalumab, MPDL3280A, BMS-936559, MEDI-4736, MSB 00107180, inhibitory antibodies against LAG-3 (lymphocyte activation gene 3), TIM3 (T-cell immunoglobulin and mucin-3), B7-H3, B7-H4, TIGIT (T-cell immunoreceptor with Ig and ITIM domains), AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS (inducible T-cell costimulatory), DLBCL (diffuse large B-cell lymphoma) inhibitors, BTLA (B and T lymphocyte attenuator), PDR001, and any combination thereof. Dosage ranges of the foregoing are known in or readily within the skill in the art as several dosing clinical trials have been completed, making extrapolation to other agents possible.

By way of example, but not by way of limitation, in some embodiments, the one or more immune system stimulators are selected from among a natural killer cell (NK) stimulator, an antigen presenting cell (APC) stimulator, a granulocyte macrophage colony-stimulating factor (GM-CSF), and a toll-like receptor stimulator.

In some embodiments, the NK stimulator includes, but is not limited to, IL-2, IL-15, IL-15/IL-15RA complex, IL-18, and IL-12. In some embodiments, the NK stimulator includes an antibody that stimulates at least one of the following receptors NKG2, KIR2DL1/S1, KRI2DL5A, NKG2D, NKp46, NKp44, or NKp30.

In some embodiments, the APC stimulator includes, but is not limited to, CD28, ICOS, CD40, CD30, CD27, OX-40, and 4-1BB.

In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63-RΔM64R-hFlt3L-OX40L, MYXVΔM62RΔM63RΔM64-RΔM31R-hFlt3L-OX40L, MYXVΔM62RΔM63RΔM64-RΔM31R-hFlt3L-OX40L-IL-12, MYXVΔM62RΔM63RΔ-M64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4 and one or more immune checkpoint inhibitors and/or one or more immune system stimulators results in a synergistic effect. In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hil-12, MVAΔE3LΔE5R-hFlt3L-mOX40LΔWR199-hIL-12ΔC11R, MVAΔE3-LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63-RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64-RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔ-M64RΔM31R-hFlt3L-OX40L-IL-12-IL-15/IL-15Rα-anti-CTLA-4 and one or more immune checkpoint inhibitors and/or one or more immune system stimulators results in an enhanced anti-tumor effect. In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3-LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63-RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64R-ΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4 and anti-PD-L1 results in a synergistic effect with respect to the treatment of solid tumors. In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-C11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15RΔ-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63RΔ-M64R-hFlt3L-OX40L, MYXVΔM62RΔM63RΔM6-4RΔM31R-hFlt3L-OX40L, MYXVΔM62RΔM63RΔM6-4RΔM31R-hFlt3L-OX40L-IL-12, MYXVΔM62RΔM-63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔ-M64RΔM31R-hFlt3L-OX40L-IL-12-IL-15/IL-15Rα-anti-CTLA-4 and anti-PD-1 results in a synergistic effect with respect to the treatment of solid tumors. In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199μWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63-RΔM64R-hFlt3L-OX40L, MYXVΔM62RΔM63RΔ-M64RΔM31R-hFlt3L-OX40L, MYXVΔM62RΔM63RΔ-M64RΔM31R-hFlt3L-OX40L-IL-12, MYXVΔM62-RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔ-M63RΔM64RΔM31R-hFlt3L-OX40L-IL-12-IL-15/IL-15Rα-anti-CTLA-4 and anti-CTLA-4 results in a synergistic effect with respect to the treatment of solid tumors.

In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔ-M63RΔM64R-hFlt3L-OX40L, MYXVΔM62RΔM63-RΔM64R-hFlt3L-OX40L, MYXVΔM62RΔM63RΔM6-4RΔM31R-hFlt3L-OX40L, MYXVΔM62RΔM63RΔM6-4RΔM31R-hFlt3L-OX40L-IL-12, MYXVΔM62RΔM63-RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM6-4RΔM31R-hFlt3L-OX40L-IL-12-IL-15/IL-15Rα-anti-CTLA-4 with one or more immune checkpoint blocking agents and/or one or more immune system stimulators is further combined or separately, sequentially, or simultaneously (i.e., concurrently) administered with one or more anti-cancer drugs and/or immunomodulatory drugs described below in Sections XVI B and C. In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15RΔ, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 with one or more immune checkpoint blocking agents and/or one or more immune system stimulators and one or more anti-cancer drugs and/or immunomodulatory drugs described below in Sections XVI B and C results in a synergistic effect with respect to the treatment of solid tumors.

It has been reported that the sequential (i.e., serial) administration of anti-OX40 antibody followed by the immune checkpoint inhibitor, anti-PD-1 antibody, improves the therapeutic efficacy of the combination, resulting in delayed tumor progression and, in some cases, complete tumor regression. (See, e.g., Shrimali et al., *Cancer Immunol. Res.*5(9): OF1-OF12 (2017); Messenheimer et al., *Clin. Cancer Res.* 23(20):6165-6177 (2017)). However, the same studies show that the simultaneous (i.e., concurrent) administration of anti-OX40 antibody and anti-PD-1 antibody negates the anti-tumor effects of OX40 antibody and results in poor treatment outcomes in mice. (See, Shrimali et al., (2017); Messenheimer et al., (2017)). By contrast, as shown in FIGS. 11B-11G, the combined, simultaneous (i.e., concurrent) administration of the viruses expressing the OX40L transgene of the present technology (e.g., MVAΔC7L-hFl3L-OX40L) and an immune checkpoint inhibitor (e.g., MVAΔC7L-hFl3L-OX40L+anti-PD-L1 or MVAΔC7L-hFl3L-OX40L+anti-CTLA-4 or MVAΔC7L-hFl3L-OX40L+anti-PD-1 (not shown)) in a mouse melanoma model surprisingly and unexpectedly results in enhanced anti-tumor effects in both injected and non-injected tumors and increased survival as compared to controls. In some embodiments, the combination of the viruses expressing the OX40L transgene of the present technology, e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACV-TK$^-$-anti-CTLA-4-ΔE5R-hFlt3L-OX40L, VACVE3LΔ83N-ΔTK-anti-CTLA-4-ΔE5R-hFlt3L-OX40L-IL-12, VACVE3L-Δ83N-ΔTK-anti-CTLA-4-ΔE5R-hFlt3L-OX40L-IL-12-ΔB2R, MYXVΔM31R-hFlt3L-OX40L, MVAΔE5R-hFlt3L-OX40L-ΔWR199, MVAΔE3LΔE5R-hFlt3L-mOX40-LΔWR199-hIL-12, MVAΔE3LΔE5R-hFlt3L-mOX40-LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L- hIL-12ΔB2RΔWR199ΔWR200-hIL-15/IL-15RΔ, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR-199ΔWR200-hIL-15/IL-15RαΔC11R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64R-ΔM31R-hFlt3L-OX40L-IL-12-IL-15/IL-15Rα, MYXVΔM62RΔM63RΔM64RΔM31R-hFlt3L-OX40L-IL-12-anti-CTLA-4, and MYXVΔM62RΔM63RΔM64RΔM31R-hFlt3L-OX40L-IL-12-IL-15/IL-15Rα-anti-CTLA-4 and/or and one or more immune checkpoint inhibitors (e.g., anti-PD-L1 antibody, anti-PD-1 antibody, anti-CTLA-4 antibody) results in a surprising and unexpected enhanced anti-tumor effect as compared to the combination of an immune checkpoint inhibitor and anti-OX40 agonist antibody. In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE-3LΔE5R-hFlt3L-OX40L-ΔC11R, VACVΔC7L-OX40L, VACVΔC7L-hFlt3L-OX40L, VACV-TK$^-$-anti-CTLA-4-ΔE5R-hFlt3L-OX40L, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔ-M31R-hFlt3L-OX40L, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R-hFlt3L-OX40L, MYXVΔM62RΔM63RΔM64R-hFlt3L-OX40L, MYXV-ΔM62RΔM63RΔM64RΔM31R-hFlt3L-OX40L, MYXV-ΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and MYXVΔM62-RΔM63RΔM64RΔM31R-hFlt3L-OX40L-IL-12-IL-15/IL-15Rα-anti-CTLA-4 and one or more immune checkpoint inhibitors (e.g., anti-PD-L1 antibody, anti-PD-1 antibody, anti-CTLA-4 antibody) results in a surprising and unexpected synergistic effect with respect to the treatment of solid tumors as compared to the combination of an immune checkpoint inhibitor and anti-OX40 agonist antibody.

B. Anti-Cancer Drugs

Receptor tyrosine kinases, such as EGFR and HER2, have been implicated in promoting tumor cell proliferation and survival through the Ras-Raf-Mek-Erk (Ras-MAPK) pathway. Raf and Mek are also targets for inhibiting oncogenic signals arising from upstream receptor tyrosine kinases or from gain-of-function mutations in RAS or RAF that drive Ras-MAPK signaling. The identification of key activating mutations in cancers including melanoma have led to the development of targeted therapies along the MAPK-pathway. For example, activating mutations in BRAF occur in over half of the melanoma cancers, a majority of which include the $BRAF^{V600E}$ mutation, which constitutively activates the MAPK signaling pathway. This in turn leads to increased metastatic behavior including invasiveness, while reducing apoptosis (i.e., increasing cancer cell survival). Several anti-cancer drugs have been developed to mitigate the pathogenic signaling from this pathway. Focused therapies targeting this pathway include inhibitors of EGFR, HER2, BRAF, RAF, and MEK.

Immunotherapies consisting of checkpoint inhibitors (PD-1/PD-L1, CTLA-4) and combinations of MAPK-pathway targeted therapies have shown promising results in, for example, BRAF-positive advanced melanoma. It has been reported that MAPK pathway activation contributes to immune escape, while MAPK pathway inhibition contributes to a more favorable immune environment via abrogation of immunosuppressive factors as well as dysregulation of certain other immunoregulatory proteins such as PD-L1. Furthermore, oncolytic herpes virus (T-Vec) in dual combination with MAPK pathway inhibition has been shown in preclinical models to increase cancer cell death as compared with single agent alone, while the triple combination of MAPK-inhibitor, T-Vec, and a checkpoint inhibitor (e.g., anti-PD-L1 antibody) showed synergistic immunostimulatory effects. Robust immune response with MAPK pathway inhibition has been strongly associated with increased activation of CD8 T-cell influx and increased levels of secreted IFN and TNF-α.

Figure 60A:
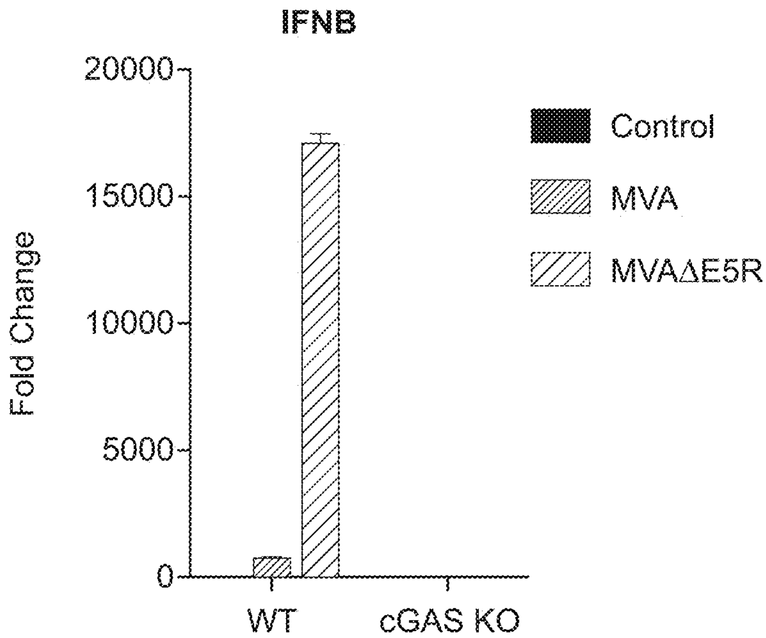
FIGS. 60A-60D show that MVAΔE5R-induced IFNB gene expression and IFN-β secretion was dependent on cGAS.

As demonstrated herein, the recombinant viral constructs of the present technology comprising deletions of E5R (or its orthologue), such as MVAΔE5R, VACVΔE5R, and MYXVΔM31R, significantly increase IFN gene expression levels greater than 1000-fold compared to a corresponding wild-type virus (see FIG. 60A).

In some embodiments, MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔ-M63RΔM64R-hFlt3L-OX40L, MYXVΔM62RΔ-M63RΔM64R-hFlt3L-OX40L, MYXVΔM62RΔM6-3RΔM64RΔM31R-hFlt3L-OX40L, MYXVΔM62-RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔ-M62RΔM63RΔM64RΔM31R-hFlt3L-OX40L-IL-12-IL-15/IL-15Rα-anti-CTLA-4 is combined or separately, sequentially, or simultaneously (i.e., concurrently) administered with one or more anti-cancer drugs selected from the group consisting of Mek inhibitors (e.g., U0126, selumitinib (AZD6244), PD98059, trametinib, cobimetinib), EGFR inhibitors (e.g., lapatinib (LPN), erlotinib (ERL)), HER2 inhibitors (e.g., lapatinib (LPN), Trastuzumab), Raf inhibitors (e.g., sorafenib (SFN)), BRAF inhibitors (e.g., dabrafenib, vemurafenib), an anti-OX40 antibody, a GITR agonist antibody, an anti-CSFR antibody, a CSFR inhibitor, paclitaxel, TLR9 agonist CpG, and VEGF inhibitors (e.g., Bevacizumab).

In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L- hOX40L-hIL-12ΔB2RΔWR199ΔWR200-hIL-15/IL-15RΔ, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔ-M63RΔM64R-hFlt3L-OX40L, MYXVΔM62RΔM63-RΔM64R-hFlt3L-OX40L, MYXVΔM62RΔM63RΔM64R-ΔM31R-hFlt3L-OX40L, MYXVΔM62RΔM63RΔM64-RΔM31R-hFlt3L-OX40L-IL-12, MYXVΔM62RΔM63R-ΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔ-M64RΔM31R-hFlt3L-OX40L-IL-12-IL-15/IL-15Rα-anti-CTLA-4 with one or more anti-cancer drugs is further combined or separately, sequentially, or simultaneously (i.e., concurrently) administered with one or more immune checkpoint blocking agents and/or one or more immune system stimulators as described in Section XVI A. In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63RΔ-M64R-hFlt3L-OX40L, MYXVΔM62RΔM63RΔM-64RΔM31R-hFlt3L-OX40L, MYXVΔM62RΔM63RΔM64-RΔM31R-hFlt3L-OX40L-IL-12, MYXVΔM62RΔM63RΔ-M64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4 with the one or more anti-cancer drugs and one or more immune checkpoint blocking agents and/or one or more immune system stimulators results in a synergistic effect with respect to the treatment of solid tumors.

In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE≡R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15αa, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63-RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM6-4RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔ-M64RΔM31R-hFlt3L-OX40L-IL-12-IL-15/IL-15Rα-anti-CTLA-4 with one or more anti-cancer drugs is further combined or separately, sequentially, or simultaneously (i.e., concurrently) administered with one or more immune checkpoint blocking agents and/or one or more immune system stimulators as described in Section XVI A, and/or immunomodulatory drugs described in Section XVI C. In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL- 15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63R-ΔM64R-hFlt3L-OX40L, MYXVΔM62RΔM63RΔM64R-ΔM31R-hFlt3L-OX40L, MYXVΔM62RΔM63RΔM64RΔ-M31R-hFlt3L-OX40L-IL-12, MYXVΔM62RΔM63R-ΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔ-M64RΔM31R-hFlt3L-OX40L-IL-12-IL-15/IL-15Rα-anti-CTLA-4 with the one or more anti-cancer drugs, one or more immune checkpoint blocking agents or immune system stimulators and/or immunomodulatory drugs, results in a synergistic effect with respect to the treatment of solid tumors.

C. Immunomodulatory Drugs

Fingolimod (FTY720) is an orally active immunomodulatory drug used to treat multiple sclerosis. Fingolimod acts as a sphingosine-1-phosphate receptor modulator which blocks lymphocyte egress from lymph nodes.

In some embodiments, MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3L83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63RΔ-M64R-hFlt3L-OX40L, MYXVΔM62RΔM63RΔM64RΔ-M31R-hFlt3L-OX40L, MYXVΔM62RΔM63RΔM64RΔ-M31R-hFlt3L-OX40L-IL-12, MYXVΔM62RΔM63R-ΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63R-ΔM64RΔM31R-hFlt3L-OX40L-IL-12-IL-15/IL-15Rα-anti-CTLA-4 is combined or separately, sequentially, or simultaneously (i.e., concurrently) administered with FTY720.

In some embodiments, the combination of MVAΔE3L-OX40L, MVAΔC7L- OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔ-M63RΔM64R-hFlt3L-OX40L, MYXVΔM62RΔM63-RΔM64RΔM31R-hFlt3L-OX40L, MYXVΔM62R-ΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 with FTY720 is further combined or separately, sequentially, or simultaneously (i.e., concurrently) administered with one or more immune checkpoint blocking agents and/or one or more immune system stimulators as described in Section XVI A and/or anti-cancer drugs described in Section XVI B. In some embodiments, the combination of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L- ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L- hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXV-ΔM63RΔM64R-hFlt3L-OX40L, MYXVΔM62RΔ-M63RΔM64R-hFlt3L-OX40L, MYXVΔM62RΔ-M63RΔM64RΔM31R-hFlt3L-OX40L, MYXVΔM62R-ΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM-62RΔM63RΔM64RΔM31R-hFlt3L-OX40L-IL-12-IL-15/IL-15Rα-anti-CTLA-4 with FTY720, one or more immune checkpoint blocking agents, and/or immune system stimulators, and/or anti-cancer drugs, results in a synergistic effect with respect to the treatment of solid tumors.

XVII Kits Comprising Engineered MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-≠E5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 Viruses The present disclosure provides for kits comprising one or more compositions comprising one or more of the engineered poxviruses, e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔ-M63RΔM64R-hFlt3L-OX40L, MYXVΔM62RΔ-M63RΔM64R-hFlt3L-OX40L, MYXVΔM62RΔM6-3RΔM64RΔM31R-hFlt3L-OX40L, MYXVΔM62RΔ-M63RΔM64RΔM31R-hFlt3L-OX40L-IL-12, MYXVΔ-M62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62-RΔM63RΔM64RΔM31R-hFlt3L-OX40L-IL-12-IL-15/IL-15Rα-anti-CTLA-4, described hereintogether with instructions for the administration of the engineered poxviruses to a subject to be treated. The instructions may indicate a dosage regimen for administering the composition or compositions as provided below.

In some embodiments, the kit may also comprise an additional composition comprising one or more immune checkpoint blocking agents and/or one or more immune system stimulators for conjoint administration with the engineered poxvirus, e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔ-

E3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, composition.

In some embodiments, the kit may also comprise an additional composition comprising one or more anti-cancer drugs for conjoint administration with the engineered poxvirus, e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, composition.

In some embodiments, the kit may also comprise an additional composition comprising an immunomodulatory drug for conjoint administration with the engineered poxvirus, e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, composition.

In some embodiments, the kit may also comprise an additional composition comprising one or more immune checkpoint blocking agents and/or one or more immune system stimulators, and one or more anti-cancer drugs for conjoint administration with the engineered poxvirus, e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/

IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63R-ΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64R-ΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, composition.

In some embodiments, the kit may also comprise an additional composition comprising any combination of one or more immune checkpoint blocking agents and/or one or more immune system stimulators, one or more anti-cancer drugs, and an immunomodulatory drug for conjoint administration with the engineered poxvirus, e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L- IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64R-ΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, composition.

XVIII. Effective Amount and Dosage of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4

In general, the subject is administered a dosage of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα- OX40L, VACVΔE3L83N-

ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR-199ΔWR200-hIL-15/IL-15Rα, VACVΔE3L83N-ΔTK-anti-huCTLA-4-ΔE5R-hFlt3L-hOX40L-hIL-12ΔB2RΔWR-199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔ-M62RΔM63RΔM64R-hFlt3L-OX40L, MYXVΔ-M62RΔM63RΔM64RΔM31R-hFlt3L-OX40L, MYXV-ΔM62RΔM63- RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔ-M62RΔM63RΔM64RΔM31R-hFlt3L-OX40L-IL-12-IL-15/IL-15Rα-anti-CTLA-4 in the range of about $10^6$ to about $10^{10}$ plaque forming units (pfu), although a lower or higher dose may be administered. In some embodiments, the dosage ranges from about $10^2$ to about $10^{10}$ pfu. In some embodiments, the dosage ranges from about $10^3$ to about $10^{10}$ pfu. In some embodiments, the dosage ranges from about $10^4$ to about $10^{10}$ pfu. In some embodiments, the dosage ranges from about $10^5$ to about $10^{10}$ pfu. In some embodiments, the dosage ranges from about $10^6$ to about $10^{10}$ pfu. In some embodiments, the dosage ranges from about $10^7$ to about $10^{10}$ pfu. In some embodiments, the dosage ranges from about $10^8$ to about $10^{10}$ pfu. In some embodiments, the dosage ranges from about $10^9$ to about $10^{10}$ pfu. In some embodiments, dosage is about $10^7$ to about $10^9$ pfu. The equivalence of pfu to virus particles can differ according to the specific pfu titration method used. Generally, a pfu is equal to about 5 to 100 virus particles and 0.69 pfu is about 1 TCID50. A therapeutically effective amount of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3L-ΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63RΔM6-4R-hFlt3L-OX40L, MYXVΔM62RΔM63RΔM64RΔ-M31R-hFlt3L-OX40L, MYXVΔM62RΔM63RΔM64-RΔM31R-hFlt3L-OX40L-IL-12, MYXVΔM62RΔM63-RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔ-M64RΔM31R-hFlt3L-OX40L-IL-12-IL-15/IL-15Rα-anti-CTLA-4 can be administered in one or more divided doses for a prescribed period of time and at a prescribed frequency of administration.

For example, as is apparent to those skilled in the art, a therapeutically effective amount of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔ-M63RΔM64R-hFlt3L-OX40L, MYXVΔM62RΔM-63RΔM64R-hFlt3L-OX40L, MYXVΔM62RΔM63-RΔM64RΔM31R-hFlt3L-OX40L, MYXVΔM62RΔ-M63RΔM64RΔM31R-hFlt3L-OX40L-IL-12, MYXV-ΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM-62RΔM63RΔM64RΔM31R-hFlt3L-OX40L-IL-12-IL-15/IL-15Rα-anti-CTLA-4 in accordance with the present disclosure may vary according to factors such as the disease state, age, sex, weight, and general condition of the subject, and the ability of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L- mOX40LΔWR199-hIL-12, MVAΔE3LΔE5R-hFlt3L-mOX40LΔWR199-hIL-12ΔC11R, MVAΔE3LΔE-

5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM6-3RΔM64R-hFlt3L-OX40L, MYXVΔM62RΔM63RΔ-M64R-hFlt3L-OX40L, MYXVΔM62RΔM63RΔM64R-ΔM31R-hFlt3L-OX40L, MYXVΔM62RΔM63RΔM64R-ΔM31R-hFlt3L-OX40L-IL-12, MYXVΔM62RΔ-M63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔ-M63RΔM64RΔM31R-hFlt3L-OX40L-IL-12-IL-15/IL-15Rα-anti-CTLA-4 to elicit a desired immunological response in the particular subject (the subject's response to therapy). In delivering MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔER, VACV-TK$^{-}$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔ-M63RΔM64R-hFlt3L-OX40L, MYXVΔM62R-ΔM63RΔM64R-hFlt3L-OX40L, MYXVΔM62RΔM63-RΔM64RΔM31R-hFlt3L-OX40L, MYXVΔM62RΔM63R-ΔM64RΔM31R-hFlt3L-OX40L-IL-12, MYXVΔM62RΔ-M63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM6-3RΔM64RΔM31R-hFlt3L-OX40L-IL-12-IL-15/IL-15Rα-anti-CTLA-4 to a subject, the dosage will also vary depending upon such factors as the general medical condition, previous medical history, disease type and progression, tumor burden, the presence or absence of tumor infiltrating immune cells in the tumor, and the like.

In some embodiments, it may be advantageous to formulate compositions of the present disclosure in dosage unit form for ease of administration and uniformity of dosage. "Dosage unit form as used herein" refers to physically discrete units suited as unitary dosages for the mammalian subjects to be treated; each unit containing a predetermined quantity of active material calculated to produce the desired therapeutic effect in association with the required pharmaceutically or veterinary acceptable carrier.

XIX. Administration and Therapeutic Regimen of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^{-}$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4

Pharmaceutical compositions are typically formulated to be compatible with its intended route of administration. Administration of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV- TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3-LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 can be achieved using more than one route. Examples of routes of administration include, but are not limited to parenteral (e.g., intravenous, intramuscular, intraperitoneal, intradermal, subcutaneous), intratumoral, intrathecal, intranasal, systemic, transdermal, iontophoretic, intradermal, intraocular, or topical administration. In one embodiment, MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα- OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 is administered directly into the tumor, e.g., by intratumoral injection, where a direct local reaction is desired. Additionally, administration routes of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3-LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3-LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXV-ΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199WR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 can vary, e.g., first administration using an intratumoral injection, and subsequent administration via an intravenous injection, or any combination thereof. A therapeutically effective amount of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R- hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63R-ΔM64R-hFlt3L-OX40L, MYXVΔM62RΔM63RΔM64R-ΔM31R-hFlt3L-OX40L, MYXVΔM62RΔM63RΔM64-RΔM31R-hFlt3L-OX40L-IL-12, MYXVΔM62RΔM63-RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4 injection can be administered for a prescribed period of time and at a prescribed frequency of administration. In certain embodiments, MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63R-ΔM64R-hFlt3L-OX40L, MYXVΔM62RΔM63RΔM64R-ΔM31R-hFlt3L-OX40L, MYXVΔM62RΔM63RΔM6-4RΔM31R-hFlt3L-OX40L-IL-12, MYXVΔM62RΔM63R-ΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4 can be used in conjunction with other therapeutic treatments. For example, the recombinant poxvirus of the present technology can be administered in a neoadjuvant (preoperative) or adjuvant (postoperative) setting for subjects inflicted with bulky primary tumors. It is anticipated that such optimized therapeutic regimen will induce an immune response against the tumor and reduce the tumor burden in a subject before or after primary therapy, such as surgery. Furthermore, MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM6-3RΔM64R-hFlt3L-OX40L, MYXVΔM62RΔM63R-ΔM64R-hFlt3L-OX40L, MYXVΔM62RΔM63RΔM-64RΔM31R-hFlt3L-OX40L, MYXVΔM62RΔM63RΔM6-4RΔM31R-hFlt3L-OX40L-IL-12, MYXVΔM62RΔ-M63RΔM64RΔM31R-hFlt3L-OX40L-IL-12-IL-15/IL-15Rαa, MYXVΔM62RΔM63RΔM64RΔM31R-hFlt3L-OX40L-IL-12-anti-CTLA-4, and/or MYXVΔM62RΔ-M63RΔM64RΔM31R-hFlt3L-OX40L-IL-12-IL-15/IL-15Rα-anti-CTLA-4 can be administered in conjunction with other therapeutic treatments such as chemotherapy or radiation.

In certain embodiments, the MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L- hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 virus is administered at least once weekly or monthly but can be administered more often if needed, such as two times weekly for several weeks, months, years, or even indefinitely as long as benefits persist. More frequent administrations are contemplated if tolerated and if they result in sustained or increased benefits. Benefits of the present methods include but are not limited to the following: reduction of the number of cancer cells, reduction of the tumor size, eradication of tumor, inhibition of cancer cell infiltration into peripheral organs, inhibition or stabilization or eradication of metastatic growth, inhibition or stabilization of tumor growth, and stabilization or improvement of quality of life. Furthermore, the benefits may include induction of an immune response against the tumor, activation of effector $CD4^+$ T-cells, an increase of effector $CD8^+$ T-cells, or reduction of regulatory $CD4^+$ cells. For example, in the context of melanoma, a benefit may be a lack of recurrences or metastasis within one, two, three, four, five, or more years of the initial diagnosis of melanoma. Similar assessments can be made for colon cancer and other solid tumors.

In certain other embodiments, the tumor mass or tumor cells are treated with MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-C11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVZΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXV-ΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 in vivo, ex vivo, or in vitro.

XX. Vectors

In some embodiments, a pCB plasmid-based vector is used to insert a specific gene of interest (SG), such as OX40L (murine or human), under the control of the vaccinia synthetic early and late promoter (PsE/L). The methodology for constructing the vector has been described (See M. Puhlmann, C. K. Brown, M. Gnant, J. Huang, S. K. Libutti, H. R. Alexander, D. L. Bartlett, Vaccinia as a vector for tumor-directed gene therapy: Biodistribution of a thymidine kinase-deleted mutant *Cancer Gene Therapy* 7(1):66-73 (2000)). A xanthine-guanine phosphoribosyl transferase (gpt) gene under the control of vaccinia P7.5 promoter is used as a selectable marker. An illustrative pCB-mOX40L-gpt vector nucleic acid sequence is set forth in SEQ ID NO: 3. In some embodiments, a pUC57 plasmid-based vector is used to insert a specific gene of interest (SG), such as OX40L (murine or human), under the control of the vaccinia synthetic early and late promoter (PsE/L). In some embodiments, a pMA plasmid-based vector is used to insert a specific gene of interest (SG), such as OX40L (murine or human), under the control of the vaccinia synthetic early and late promoter (PsE/L). An mCherry gene under the control of vaccinia P7.5 promoter is used as a selectable marker. An illustrative pUC57-hOX40L-mCherry vector nucleic acid sequence is set forth in SEQ ID NO: 5. Additional illustrative vectors nucleic acid sequences of the present technology are shown in Tables 2-5.

In some embodiments, these expression cassettes are flanked by a partial sequence of TK gene on each side (TK-L, TK-R). Homologous recombination that occurs at the TK locus of the plasmid DNA and MVAΔE3L, MVAΔC7L, MVAΔE5R, VACVΔC7L, VACVΔE5R, or MYXVΔM31R genomic DNA results in the insertion of OX40L and selectable marker expression cassettes into the MVAΔE3L, MVAΔC7L, MVAΔE5R, VACVΔC7L, VACVΔE5R, or MYXVΔM31R genomic DNA TK locus to generate MVAΔE3L-TK(−)-OX40L, MVAΔC7L-TK(−)-OX40L, MVAΔE5R-TK(−)-OX40L, VACVΔC7L-TK(−)-OX40L, VACVΔE5R-TK(−)-OX40L, or MYXVΔM31R-TK(−)-OX40L. Additionally or alternatively, suitable loci other than the TK locus within the virus could be used. Homologous recombination that occurs at a suitable viral gene locus of the plasmid DNA and MVA, MVAΔE3L, MVAΔC7L, MVAΔE5R, VACV, VACVΔC7L, VACVΔE5R, MYXV, or MYXVΔM31R genomic DNA results in the insertion of one or more specific gene of interest (e.g., OX40L, hFlt3L, anti-CTLA-4, etc.) and/or selectable marker expression cassettes into the MVA, MVAΔE3L, MVAΔC7L, MVAΔE5R, VACVΔC7L, VACVΔE5R, MYXV, or MYXVΔM31R genomic DNA viral gene locus to generate recombinant poxviruses such as those described herein.

In some embodiments, position 18,407 to 18,859 of the MVA genomic sequence (SEQ ID NO: 1) is replaced with a heterologous nucleic acid sequence comprising one or more open reading frames that encode for a selectable marker, such as gpt or mCherry, and a gene of interest (SG), such as OX40L. In some embodiments, position 75,560 to 76,093 of the MVA genomic sequence (SEQ ID NO: 1) is replaced with a heterologous nucleic acid sequence comprising one or more open reading frames that encode for a selectable marker, such as gpt or mCherry, and a gene of interest (SG), such as OX40L. In some embodiments, position 15,716 to 16,168 of the VACV genomic sequence (SEQ ID NO: 2) is replaced with a heterologous nucleic acid sequence comprising one or more open reading frames that encode for a selectable marker, such as gpt or mCherry, and a gene of interest (SG), such as OX40L. In some embodiments, position 75,798 to 75,868 of the MVA genomic sequence (SEQ ID NO: 1) is replaced with a heterologous nucleic acid sequence comprising one or more open reading frames that encode for a selectable marker, such as gpt or mCherry, and a gene of interest (SG), such as OX40L. In some embodiments, position 80,962 to 81,032 of the VACV genomic sequence (SEQ ID NO: 2) is replaced with a heterologous nucleic acid sequence comprising one or more open reading frames that encode for a selectable marker, such as gpt or mCherry, and a gene of interest (SG), such as OX40L. The recombinant viruses are enriched by selection and plaque-purified for 4-5 rounds until the appropriate recombinant viruses are obtained.

Similarly, in some embodiments, a pUC57 plasmid-based vector is used to insert a specific gene of interest (SG), such as hFlt3L, into the MVA or VACV viral genome backbone. GFP may be used as a selectable marker. An illustrative pUC57-hFlt3L-GFP vector nucleic acid sequence is set forth in SEQ ID NO: 4. In some embodiments, these expression cassettes are flanked by a partial sequence of C7 gene on each side. Additionally or alternatively, suitable loci other than the C7 locus within the virus could be used. Homologous recombination that occurs at the C7 locus of the plasmid DNA and MVAΔE3L, MVAΔME5R, MVA, VACV, VACVΔC7L, VACVΔE5R, MYXV, or MYXVΔM31R genomic DNA results in the insertion of hFlt3L and selectable marker expression cassettes into the MVAΔE3L, MVAΔE5R, MVA, VACV, VACVΔC7L, VACVΔE5R, MYXV, or MYXVΔM31R genomic DNA C7 locus.

In some embodiments, position 18,407 to 18,859 of the MVA genomic sequence (SEQ ID NO: 1) is replaced with a heterologous nucleic acid sequence comprising one or more open reading frames that encode for a selectable marker, such as GFP, and a gene of interest (SG), such as hFlt3L. In some embodiments, position 75,560 to 76,093 of the MVA genomic sequence (SEQ ID NO: 1) is replaced with a heterologous nucleic acid sequence comprising one or more open reading frames that encode for a selectable marker, such as gpt or mCherry, and a gene of interest (SG), such as hFlt3L. In some embodiments, position 15,716 to 16,168 of the VACV genomic sequence (SEQ ID NO: 2) is replaced with a heterologous nucleic acid sequence comprising one or more open reading frames that encode for a selectable marker, such as GFP, and a gene of interest (SG), such as hFlt3L. In some embodiments, position 80,962 to 81,032 of the VACV genomic sequence (SEQ ID NO: 2) is replaced with a heterologous nucleic acid sequence comprising one or more open reading frames that encode for a selectable marker, such as GFP, and a gene of interest (SG), such as hFlt3L. The recombinant viruses are enriched by selection and plaque-purified for 4-5 rounds until the appropriate recombinant viruses are obtained.

In some embodiments, position 38,432 to 39,385 of the MVA genomic sequence (SEQ ID NO: 1) is replaced with a heterologous nucleic acid sequence comprising one or more open reading frames that encode for a selectable marker, such as mCherry, and/or a gene of interest (SG), such as hFlt3L and/or OX40L. The recombinant viruses are enriched by selection and plaque-purified for 4-5 rounds until the appropriate recombinant viruses are obtained.

In some embodiments, position 49,236 to 50,261 of the VACV genomic sequence (SEQ ID NO: 2) is replaced with a heterologous nucleic acid sequence comprising one or more open reading frames that encode for a selectable marker, such as mCherry, and/or a gene of interest (SG), such as hFlt3L and/or OX40L. The recombinant viruses are enriched by selection and plaque-purified for 4-5 rounds until the appropriate recombinant viruses are obtained.

In some embodiments, both a pCB-OX40L-gpt vector or a pUC57-OX40L-mCherry vector or a pUC57-OX40L-mCherry vector and a pUC57-hFlt3L-GFP vector are used to insert OX40L into the TK locus and hFlt3L into the C7 locus to generate MVAΔC7L-hFlt3L-TK(−)-OX40L or VACVΔC7L-hFlt3L-TK(−)-OX40L.

It will be appreciated, that any other expression vector suitable for integration into the MVA, VACV, or MYXV genome could be used as well as alternative promoters, regulatory elements, selectable markers, cleavage sites, and/or nonessential insertion regions of MVA, VACV, or MYXV. In some embodiments, the selectable marker is a reporter protein, wherein the reporter protein is a bioluminescent protein, a fluorescent protein, or a chemiluminescent protein. In some embodiments, the reporter protein is green fluorescent protein (GFP). In some embodiments, the selectable marker is xanthine-guanine phophoribosyl transferase gene (gpt). In some embodiments, the selectable marker is an mCherry gene. MVA, VAVC, and MYXV encode many immune modulatory genes at the ends of the linear genome, including C11, K3, F1, F2, F4, F6, F8, F9, F11, F14.5, J2, A46, E3L, B18R (WR200), E5R, K7R, C12L, B8R, B14R, N1L, C11R, K1L, C16, M1L, N2L, and WR199 (or their orthologs). These genes (or their orthologs) can be deleted to potentially enhance immune activating properties of the virus, and allow insertion of transgenes.

XXI. Delivery of the Engineered Poxvirus Strains of the Present Technology as an Adjuvant to a Subject to Treat Cancer

A. Compositions

Immune-Activating Cancer Vaccine Adjuvants

Recent discoveries of cancer neoantigens have generated a renewed interest in cancer vaccination and the combination of cancer vaccination with immune checkpoint blockade to enhance vaccination effects. Developing effective vaccine adjuvants that can maximize antitumor immune responses is critical for the success of cancer vaccines.

Cancer vaccines comprise cancer antigens and immune adjuvants. Cancer antigens generally include tumor differentiation antigens, cancer testis antigens, neoantigens, and viral antigens in the case of tumors associated with oncogenic virus infection. Cancer antigens can be provided in the form of irradiated tumor cells, dendritic cells (DCs) loaded with tumor cell lysates or peptides, DNA or RNA encoding antigen, as well as oncolytic virus with transgene(s) encoding cancer antigen(s). Dendritic cells (DCs) are professional antigen-presenting cells that are important for priming naive T-cells to generate antigen-specific T-cell responses. Immune adjuvants are agents that promote antigen uptake by DCs and/or DC maturation and activation. Several immune adjuvants, including toll-like receptor (TLR) agonists, poly (I:C) (TLR3 agonist), CpG (TLR9 agonist), Imiquimod (TLR7 agonist), as well as STING agonists, have been shown to improve vaccine efficacy in preclinical models and clinical settings.

Engineered Poxvirus Strains of the Present Technology as Adjuvant Therapy

The disclosure of the present technology relates to the use of the engineered poxvirus strains described herein (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R -hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔ-E5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N -ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, and/or Heat-iMVAΔE5R) as vaccine adjuvants. In some embodiments, the disclosure of the present technology relates to the use of MVAΔC7L-hFlt3L-TK(−)-OX40L as a vaccine adjuvant. In some embodiments, the disclosure of the present technology relates to the use of MVAΔC7L-hFlt3L-TK(−)-OX40L in combination with Heat-inactivated vaccinia (Heat-iMVA, Heat-iMVAΔE5R) as a vaccine adjuvant. Heat-iMVA has been shown to induce type I IFN in conventional DCs (cDCs) via the cGAS/STING-dependent pathway and also induces type I IFN in plasmacytoid DCs (pDCs) via the TLR7/MyD88-dependent mechanism. Moreover, intratumoral injection of Heat-iMVA eradicates injected tumors and leads to the generation of systemic antitumor immunity either as monotherapy or in combination with immune checkpoint blockade (ICB).

Target Antigens

The compositions and methods disclosed herein are not intended to be limited by the choice of antigen or neoantigen. While numerous examples of antigens and neoantigens are provided, the skilled artisan can easily utilize the adjuvant disclosed herein with an antigen or neoantigen of choice. Exemplary, non-limiting target antigens that may be used in therapeutic regimens of the present technology include tumor differentiation antigens, cancer testis antigens, neoantigens, viral antigens in the case of tumors associated with oncogenic virus infection, GPA33, HER2/neu, GD2, MAGE-1, MAGE-3, BAGE, GAGE-1, GAGE-2, MUM-1, CDK4, N-acetylglucosaminyltransferase, p15, gp75, beta-catenin, ErbB2, cancer antigen 125 (CA-125), carcinoembryonic antigen (CEA), RAGE, MART (melanoma antigen), MUC-1, MUC-2, MUC-3, MUC-4, MUC-5ac, MUC-16, MUC-17, tyrosinase, tyrosinase-related proteins 1 and 2, Pmel 17 (gp100), GnT-V intron V sequence (N-acetylglucoaminyltransferase V intron V sequence), Prostate cancer psm, PRAME (melanoma antigen), β-catenin, EBNA (Epstein-Barr Virus nuclear antigen) 1-6, p53, kras, lung resistance protein (LRP) Bcl-2, prostate specific antigen (PSA), Ki-67, CEACAM6, colon-specific antigen-p (CSAp), NY-ESO-1, human papilloma virus E6 and E7, and combinations thereof. In some embodiments, the antigen comprises a neoantigen selected from the group consisting of M27 (REGVELCPGNKYEMRRHGTTHSL VIHD) (SEQ ID NO: 17), M30 (PSKPSFQEFVD-WENVSPELNSTDQPFL) (SEQ ID NO: 18), M48 (SHCH-WNDLAVIPAGVVHNWDFEPRKVS) (SEQ ID NO: 19), and combinations thereof. The target antigen may also be a fragment or fusion polypeptide comprising an immunologically active portion of the antigens listed above.

Immune Checkpoint Blockade (ICB)

In some embodiments, the immunogenic compositions of the present technology further comprise one or more immune checkpoint blockade agents. Immune checkpoint blockade (ICB) antibodies have been at the forefront of immunotherapy and have been accepted as one of the pillars of cancer management options, including surgery, radiation, and chemotherapy. Because immune checkpoints have been implicated in the downregulation of antitumor immunity, agents and antibodies targeting immune checkpoint proteins or their ligands (CTLA-4, PD-1, or PD-L1) have been successful in disinhibiting antitumor T-cells, thereby leading to proliferation and survival of activated T-cells. This has led to the FDA approval of multiple immune checkpoint blockade (ICB) agents for patients with advanced cancers of various histological types, including melanoma, non-small cell lung cancer, renal cell carcinoma, Hodgkin lymphoma, head-and-neck cancer, urothelial carcinoma, Merkel cell carcinoma, PD-L1$^+$ gastric adenocarcinoma, as well as mismatch repair deficient and microsatellite instability (MSI) high metastatic solid tumors.

Non-limiting examples of immune checkpoint blocking agents include agents or antibodies that modulate the activity of one or more checkpoint proteins including anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001 and any combination thereof.

Pharmaceutical Compositions and Preparations of the Present Technology

Disclosed herein are pharmaceutical compositions comprising an antigen and MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3L-ΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3-LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXV-ΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40L-ΔWR199-hIL-12, MVAΔE3LΔE5R-hFlt3L-mOX40LΔW-R199-hIL-12ΔC11R, MVAΔE3LΔE5R-hFlt3L-mOX40-LΔWR199-hIL-12ΔC11R-hIL-15/IL-15α, VACVΔE5R-IL-15/IL-15Rα, VACVΔE5R-IL-15/IL-15Rα-OX40L, VACV-ΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔ-WR199ΔWR200-hIL-15/IL-15Rα, VACVΔE3L83N-ΔTK-anti-huCTLA-4-ΔE5R-hFlt3L-hOX40L-hIL-12ΔB2RΔ-WR199ΔWR200ΔC11R, VACVΔE3L83N-ΔTK-anti-huCTLA-4-ΔE5R-hFlt3L-hOX40L-hIL-12ΔB2RΔW-R199ΔWR200-hIL-15/IL-15RαΔC11R, MYXVΔM-63RΔM64R, MYXVΔM62R, MYXVΔM62RΔM6-3RΔM64R, MYXVΔM31R, MYXVΔM62RΔM63RΔM-64RΔM31R, MYXVΔM63RΔM64R-hFlt3L-OX40L, MYXVΔM62RΔM63RΔM64R-hFlt3L-OX40L, MYXVΔ-M62RΔM63RΔM64RΔM31R-hFlt3L-OX40L, MYXVΔ-M62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM-62RΔM63RΔM64RΔM31R-hFlt3L-OX40L-IL-12-IL-15/IL-15Rα-anti-CTLA-4, and/or Heat-iMVAΔE5R as an adjuvant that may contain a carrier or diluent, which can be a solvent or dispersion medium containing, for example, water, saline, Tris buffer, polyol (for example, glycerol, propylene glycol, and liquid polyethylene glycol, and the like), suitable mixtures thereof, and vegetable oils. In some embodiments, the pharmaceutical compositions comprise an antigen and MVAΔC7L-hFlt3L-TK(−)-OX40L and Heat-iMVA as adjuvants. The proper fluidity can be maintained, for example, by the use of a coating such as lecithin, by the maintenance of the required particle size in the case of dispersion and by the use of surfactants. Prevention of the action of microorganisms can be effected by various antibacterial and antifungal agents and preservatives, for example, parabens, chlorobutanol, phenol, sorbic acid, thimerosal, and the like. In some embodiments, isotonic agents, for example, sugars or sodium chloride, and buffering agents are included. Prolonged absorption of the injectable compositions can be brought about by the use in the compositions of agents delaying absorption, for example, aluminum monostearate and gelatin or carrier molecules. Other excipients may include wetting or emulsifying agents. In general, excipients suitable for injectable preparations can be included as apparent to those skilled in the art.

Pharmaceutical compositions and preparations comprising an antigen and MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX4LΔWR199-hIL-12, MVAΔE3LΔE5R-hFlt3L-mOX40LΔWR199-hIL-12ΔC11R, MVAΔE3LΔE5R-hFlt3L- mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63R-ΔM64R-hFlt3L-OX40L, MYXVΔM62RΔM63RΔM64RΔ-M31R-hFlt3L-OX40L, MYXVΔM62RΔM63RΔM6-4RΔM31R-hFlt3L-OX40L-IL-12, MYXVΔM62R-ΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM-63RΔM64RΔM31R-hFlt3L-OX40L-IL-12-IL-15/IL-15Rα-anti-CTLA-4, and/or Heat-iMVAΔE5R as an adjuvant may be manufactured by means of conventional mixing, dissolving, granulating, emulsifying, encapsulating, entrapping or lyophilizing processes. Pharmaceutical compositions may be formulated in conventional manner using one or more physiologically acceptable carriers, diluents, excipients or auxiliaries that facilitate formulating preparations suitable for in vitro, in vivo, or ex vivo use. The compositions can be combined with one or more additional biologically active agents (for example parallel administration of GM-CSF) and may be formulated with a pharmaceutically acceptable carrier, diluent or excipient to generate pharmaceutical (including biologic) or veterinary compositions of the instant disclosure suitable for parenteral or intra-tumoral administration.

Many types of formulation are possible as is appreciated by those skilled in the art. The particular type chosen is dependent upon the route of administration chosen, as is well-recognized in the art. For example, systemic formulations will generally be designed for administration by injection, e.g., intravenous, as well as those designed for intratumoral delivery. In some embodiments, the systemic or intratumoral formulation is sterile.

Sterile injectable solutions are prepared by incorporating an antigen and MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔ-E5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63R-ΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔ-M31R-hFlt3L-OX40L-IL-12-IL-15/IL-15Rα, MYXVΔ-M62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, and/or Heat-iMVAΔE5R as an adjuvant in the required amount of the appropriate solvent with various other ingredients enumerated herein, as required, followed by suitable sterilization means. Generally, dispersions are prepared by incorporating the various sterilized active ingredients into a sterile vehicle that contains the basic dispersion medium and the required other ingredients from those enumerated above. In the case of sterile powders for the preparation of sterile injectable solutions, the preferred methods of preparation are vacuum drying and freeze-drying techniques, which yield a powder of the virus plus any additional desired ingredient from a previously sterile-filtered solution thereof.

In some embodiments, an antigen and MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔ-M64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔ-M31R-hFlt3L-OX40L-IL-12-IL-15/IL-15Rα, MYXVΔ-M62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4 and/or Heat-iMVAΔE5R compositions of the present disclosure may be formulated in aqueous solutions, or in physiologically compatible solutions or buffers such as Hanks's solution, Ringer's solution, mannitol solutions or physiological saline buffer. In certain embodiments, any of the antigen and Heat-iMVA or Heat-iMVAΔE5R compositions may contain formulator agents, such as suspending, stabilizing, penetrating or dispersing agents, buffers, lyoprotectants or preservatives such as polyethylene glycol, polysorbate 80, 1-dodecylhexahydro-2H-azepin-2-one (laurocapran), oleic acid, sodium citrate, Tris HCl, dextrose, propylene glycol, mannitol, polysorbate polyethylenesorbitan monolaurate (Tween®-20), isopropyl myristate, benzyl alcohol, isopropyl alcohol, ethanol sucrose, trehalose and other such generally known in the art may be used in any of the compositions of the instant disclosure.

In some embodiments, the compositions of the present technology can be stored at −80° C. For the preparation of vaccine shots, e.g., $10^2$-$10^8$ or $10^2$-$10^9$ viral particles can be lyophilized, for example, in 100 ml of phosphate-buffered saline (PBS) in the presence of 2% peptone and 1% human albumin in an ampoule, preferably a glass ampoule. Alternatively, the injectable preparations can be produced by stepwise freeze-drying of the recombinant virus in a formulation. This formulation can contain additional additives such as mannitol, dextran, sugar, glycine, lactose or polyvinylpyrrolidone or other additives such as antioxidants or inert gas, stabilizers or recombinant proteins (e.g., human serum albumin) suitable for in vivo administration. The glass ampoule is then sealed and can be stored between 4° C. and room temperature for several months. In some embodiments, the ampoule is stored at temperatures below −20° C.

For therapy, the lyophilisate can be dissolved in an aqueous solution, such as physiological saline or Tris buffer, and administered either systemically or intratumorally. The mode of administration, the dose, and the number of administrations can be optimized by those skilled in the art.

The pharmaceutical compositions comprising an antigen and MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3L-ΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64R-ΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, and/or Heat-iMVAΔE5R as an adjuvant according to the present disclosure may comprise an additional adjuvant including aluminum salts, such as aluminum hydroxide or aluminum phosphate, Quil A, bacterial cell wall peptidoglycans, virus-like particles, polysaccharides, toll-like receptors, nano-beads, etc.

Vaccines

In some embodiments, compositions comprising MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔ-E5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔ-M64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔ-M31R-hFlt3L-OX40L-IL-12-IL-15/IL-15Rα, MYXVΔ-M62RΔM63RΔM64RΔM31R-hFlt3L-OX40L-IL-12-anti-CTLA-4, and/or MYXVΔM62RΔM63RΔM6- 4RΔM31R-hFlt3L-OX40L-IL-12-IL-15/IL-15Rα-anti-CTLA-4, and/or Heat-iMVAΔE5R adjuvant and one or more antigens are formulated into vaccines. In some embodiments, the compositions comprise MVAΔC7L-hFlt3L-TK(−)-OX40L as an adjuvant. In some embodiments, the compositions comprise MVAΔC7L-hFlt3L-TK(−)-OX40L and Heat-iMVA as adjuvants. In some embodiments, the vaccines are tumor antigen-containing whole cell vaccines (e.g., an irradiated whole cell vaccine). In some embodiments, the vaccines are administered to a subject to elicit an immune response against the antigens formulated therewith.

Effective Amount and Dosage of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXWΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, and/or Heat-iMVAΔE5R as a Cancer Vaccine Immune Adjuvant In general, the subject is administered a dosage of MVAΔE3L-OX40L, MVAΔC7L-OX40L, MVAΔC7L- hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3L-ΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3L-Δ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXV-ΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40L-ΔWR199-hIL-12, MVAΔE3LΔE5R-hFlt3L-mOX40LΔ-WR199-hIL-12ΔC11R, MVAΔE3LΔE5R-hFlt3L-mOX-40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3-L83N-ΔTK-anti-huCTLA-4-ΔE5R-hFlt3L-hOX40L-hIL-12ΔB2RΔWR199ΔWR200-hIL-15/IL-15Rα, VACVΔE-3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔ-WR199ΔWR200-hIL-15/IL-15RαΔC11R, MYXVΔ-M63RΔM64R, MYXVΔM62R, MYXVΔM62RΔM63-RΔM64R, MYXVΔM31R, MYXVΔM62RΔM63RΔ-M64RΔM31R, MYXVΔM63RΔM64R-hFlt3L-OX40L, MYXVΔM62RΔM63RΔM64R-hFlt3L-OX40L, MYXV-ΔM62RΔM63RΔM64RΔM31R-hFlt3L-OX40L, MYXV-ΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM6-2RΔM63RΔM64RΔM31R-hFlt3L-OX40L-IL-12-IL-15/IL-15Rα-anti-CTLA-4 and/or Heat-iMVAΔE5R in the range of about $10^6$ to about $10^{10}$ plaque forming units (pfu), although a lower or higher dose may be administered. In some embodiments, the dosage ranges from about $10^2$ to about $10^{10}$ pfu. In some embodiments, the dosage ranges from about $10^3$ to about $10^{10}$ pfu. In some embodiments, the dosage ranges from about $10^4$ to about $10^{10}$ pfu. In some embodiments, the dosage ranges from about $10^5$ to about $10^{10}$ pfu. In some embodiments, the dosage ranges from about $10^6$ to about $10^{10}$ pfu. In some embodiments, the dosage ranges from about $10^7$ to about $10^{10}$ pfu. In some embodiments, the dosage ranges from about $10^8$ to about $10^{10}$ pfu. In some embodiments, the dosage ranges from about $10^9$ to about $10^{10}$ pfu. In some embodiments, dosage is about $10^7$ to about $10^9$ pfu. The equivalence of pfu to virus particles can differ according to the specific pfu titration method used. Generally, a pfu is equal to about 5 to 100 virus particles and 0.69 PFU is about 1 TCID50. A therapeutically effective amount of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63RΔM-64R-hFlt3L-OX40L, MYXVΔM62RΔM63RΔM64RΔ-M31R-hFlt3L-OX40L, MYXVΔM62RΔM63RΔM64R-ΔM31R-hFlt3L-OX40L-IL-12, MYXVΔM62RΔM63RΔ-M64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4, and/or Heat-iMVAΔE5R can be administered in one or more divided doses for a prescribed period of time and at a prescribed frequency of administration.

For example, as is apparent to those skilled in the art, a therapeutically effective amount of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-C11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12B2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63-RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64R-ΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4, and/or Heat-iMVAΔE5R as an adjuvant in accordance with the present disclosure may vary according to factors such as the disease state, age, sex, weight, and general condition of the subject, and the ability of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3-LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L- ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3L-ΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63R-ΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM-31R-hFlt3L-OX40L-IL-12-IL-15/IL-15Rα, MYXVΔM6-2RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, and/or Heat-iMVAΔE5R to elicit a desired immunological response in the particular subject (the subject's response to therapy). In delivering MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3L-ΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63R-ΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64R-ΔM31R-hFlt3L-OX40L-IL-12-IL-15/IL-15Rα, MYXVΔ-M62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, and/or Heat-iMVAΔE5R to a subject, the dosage will also vary depending upon such factors as the general medical condition, previous medical history, disease type and progression, tumor burden, the presence or absence of tumor infiltrating immune cells in the tumor, and the like.

In some embodiments, it may be advantageous to formulate compositions of the present disclosure in dosage unit form for ease of administration and uniformity of dosage. "Dosage unit form as used herein" refers to physically discrete units suited as unitary dosages for the mammalian subjects to be treated; each unit containing a predetermined quantity of active material calculated to produce the desired therapeutic effect in association with the required pharmaceutically or veterinary acceptable carrier.

Administration and Therapeutic Regimen of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and or MYXVΔM62RΔM63RΔM64RΔM31R-hFlt3L-OX40L-IL-12-IL-15/IL-15Rα-anti-CTLA-4, and or Heat-iMVAΔE5R 40L as a Cancer Vaccine Immune Adjuvant A pharmaceutical composition is typically formulated to be compatible with its intended route of administration. Administration of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3L-ΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63R-ΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔ-M31R-hFlt3L-OX40L-IL-12-IL-15/IL-15Rα, MYXV-ΔM62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, and/or Heat-iMVAΔE5R as an adjuvant in an immunogenic composition (e.g., vaccine) can be achieved using more than one route. Examples of routes of administration include, but are not limited to parenteral (e.g., intravenous, intramuscular, intraperitoneal, intradermal, subcutaneous), intratumoral, intrathecal, intranasal, systemic, transdermal, iontophoretic, intradermal, intraocular, or topical administration. In one embodiment, the pharmaceutical composition of the present technology comprising an antigen and MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVAE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63R-ΔM64R-hFlt3L-OX40L, MYXVΔM62RΔM63RΔM64RΔ-M31R-hFlt3L-OX40L, MYXVΔM62RΔM63RΔM64R-ΔM31R-hFlt3L-OX40L-IL-12, MYXVΔM62RΔ-M63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62-RΔM63RΔM64RΔM31R-hFlt3L-OX40L-IL-12-IL-15/IL-15Rα-anti-CTLA-4, and/or Heat-iMVAΔE5R as an adjuvant is administered directly into the tumor, e.g. by intratumoral injection, where a direct local reaction is desired. In some embodiments, the pharmaceutical composition of the present technology comprising an antigen and MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM6-3RΔM64R-hFlt3L-OX40L, MYXVΔM62RΔM63RΔM6-4R-hFlt3L-OX40L, MYXVΔM62RΔM63RΔM64RΔM-31R-hFlt3L-OX40L, MYXVΔM62RΔM63RΔM64RΔM-31R-hFlt3L-OX40L-IL-12, MYXVΔM62RΔM63RΔ-M64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64-RΔM31R-hFlt3L-OX40L-IL-12-IL-15/IL-15Rα-anti-CTLA-4, and/or Heat-iMVAΔE5R as an adjuvant is administered peripherally relative to tumor beds. Additionally, the administration routes can vary, e.g., first administration using an intratumoral injection, and subsequent administration via an intravenous injection, or any combination thereof. A therapeutically effective amount of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63R-ΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64R-ΔM31R-hFlt3L-OX40L-IL-12-IL-15/IL-15Rα, MYXVΔ-M62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, and/or Heat-iMVAΔE5R as an adjuvant in a cancer vaccine injection can be administered for a prescribed period of time and at a prescribed frequency of administration. In certain embodiments, the pharmaceutical compositions of the present technology can be used in conjunction with other therapeutic treatments such as chemotherapy or radiation. In some embodiments, the pharmaceutical compositions of the present technology comprising a therapeutically effective amount of MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔ-E5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63-RΔM64R-hFlt3L-OX40L, MYXVΔM62RΔM63RΔM64-RΔM31R-hFlt3L-OX40L, MYXVΔM62RΔM63RΔM64-RΔM31R-hFlt3L-OX40L-IL-12, MYXVΔM62RΔM63-RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4, and/or Heat-iMVAΔE5R as an adjuvant can be used in conjunction with immune checkpoint blockade therapy.

In certain embodiments, the pharmaceutical composition comprising an antigen and MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM6-3RΔM64R-hFlt3L-OX40L, MYXVΔM62RΔM63-RΔM64R-hFlt3L-OX40L, MYXVΔM62RΔM63RΔ-M64RΔM31R-hFlt3L-OX40L, MYXVΔM62RΔM63RΔ-M64RΔM31R-hFlt3L-OX40L-IL-12, MYXVΔ-M62RΔM63RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔ-M63RΔM64RΔM31R-hFlt3L-OX40L-IL-12-IL-15/IL-15Rα-anti-CTLA-4, and/or Heat-iMVAΔE5R as an adjuvant is administered at least once weekly or monthly but can be administered more often if needed, such as two times weekly for several weeks, months, years or even indefinitely as long as benefits persist. More frequent administrations are contemplated if tolerated and if they result in sustained or increased benefits. Benefits of the present methods include but are not limited to the following: reduction of the number of cancer cells, reduction of the tumor size (e.g., tumor volume), eradication of tumor, inhibition of cancer cell infiltration into peripheral organs, inhibition or stabilization or eradication of metastatic growth, inhibition or stabilization of tumor growth, and stabilization or improvement of quality of life. Furthermore, the benefits may include induction of an immune response against the tumor, increased IFN-$\gamma^+$CD8$^+$ T-cells, increased IFN-$\gamma^+$CD4$^-$ T-cells, activation of effector CD4$^+$ T-cells, an increase of effector CD8$^+$ T-cells, or reduction of regulatory $CD4^+$ cells. For example, in the context of melanoma, a benefit may be a lack of recurrences or metastasis within one, two, three, four, five or more years of the initial diagnosis of melanoma. Similar assessments can be made for colon cancer and other solid tumors.

B. Methods

In one aspect, the present disclosure provides for a method for treating solid tumor by enhancing an immune response in a subject in need thereof, the method comprising administering to the subject an immunogenic composition comprising one or more antigens and an adjuvant comprising MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63-RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64RΔ-M31R-hFlt3L-OX40L-IL-12-IL-15/IL-15Rα, MYXVΔ-M62RΔM63RΔM64RΔM31R-hFlt3L-OX40L-IL-12-anti-CTLA-4, and/or MYXVΔM62RΔM63RΔM64RΔM31R-hFlt3L-OX40L-IL-12-IL-15/IL-15Rα-anti-CTLA-4, and/or Heat-iMVAΔE5R, thereby treating the tumor by enhancing immune response. In some embodiments, the adjuvant comprises MVAΔC7L-hFlt3L-TK(−)-OX40L. In some embodiments, the adjuvant comprises MVAΔC7L-hFlt3L-TK(−)-OX40L and Heat-iMVA.

In some embodiments, the disclosure provides methods comprising administering the immunogenic composition comprising one or more antigens and MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔATK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63-RΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64-RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM6-4RΔM31R-hFlt3L-OX40L-IL-12-IL-15/IL-15Rα-anti-CTLA-4, and/or Heat-iMVAΔE5R as an adjuvant to a subject in order to elicit an immune response against the antigens.

In some embodiments of the methods disclosed herein, the administration step comprises administering the immunogenic composition in multiple doses.

In some embodiments, the methods described herein further comprise administering to the subject an immune checkpoint blockade agent selected from the group consisting of anti-PD-1 antibody, anti-PD-L1 antibody, anti-CTLA-4 antibody, ipilimumab, nivolumab, pidilizumab, lambrolizumab, pembrolizumab, atezolizumab, avelumab, durvalumab, MPDL3280A, BMS-936559, MEDI-4736, MSB 00107180, LAG-3, TIM3, B7-H3, B7-H4, TIGIT, AMP-224, MDX-1105, arelumab, tremelimumab, IMP321, MGA271, BMS-986016, lirilumab, urelumab, PF-05082566, IPH2101, MEDI-6469, CP-870,893, Mogamulizumab, Varlilumab, Galiximab, AMP-514, AUNP 12, Indoximod, NLG-919, INCB024360, CD80, CD86, ICOS, DLBCL inhibitors, BTLA, PDR001, and any combination thereof. In some embodiments, the immunogenic composition is delivered to the subject separately, sequentially, or simultaneously with the administration of the immune checkpoint blockade agent.

C. Kits

In some embodiments, kits are provided. In some embodiments, the kit includes a container means and a separate portion of each of: (a) an antigen and (b) an adjuvant comprising MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK$^-$-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3-LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM6-3RΔM64R-hFlt3L-OX40L, MYXVΔM62RΔM63R-ΔM64R-hFlt3L-OX40L, MYXVΔM62RΔM63RΔM64-RΔM31R-hFlt3L-OX40L, MYXVΔM62RΔM63RΔM64-RΔM31R-hFlt3L-OX40L-IL-12, MYXVΔM62RΔM63RΔ-M64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4, and/or Heat-iMVAΔE5R. In some embodiments, the adjuvant comprises MVAΔC7L-hFlt3L-TK(−)-OX40L. In some embodiments, the adjuvant comprises MVAΔC7L-hFlt3L-TK(−)-OX40L and Heat-iMVA.

EXPERIMENTAL EXAMPLES

The present technology is further illustrated by the following examples, which should not be construed as limiting in any way.

General Materials and Methods

Viruses and Cell lines. MVA virus was kindly provided by Gerd Sutter (University of Munich), and propagated in BHK-21 (baby hamster kidney cell, ATCC CCL-10) cells. MVA is commercially and/or publicly available. MVAΔE3L virus was kindly provided by Gerd Sutter (University of Munich), and propagated in BHK-21 cells. The method of generation of MVAΔE3L Viruses was described (Hornemann et al., 2003). The viruses were purified through a 36% sucrose cushion. Heat-iMVA is generated by incubating purified MVA virus at 55° C. for 1 hour. BHK-21 were cultured in Eagle's Minimal Essential Medium (Eagle's MEM, can be purchased from Life Technologies, Cat# 11095-080) containing 10% FBS, 0.1 mM nonessential amino acids (NEAA), and 50 mg/ml gentamycin. The murine melanoma cell line B16-F10 was originally obtained from I. Fidler (MD Anderson Cancer Center). B16-F10 cells were maintained in RPMI 1640 medium supplemented with 10% FBS, 100 Units/ml penicillin, 100 μg/ml streptomycin, 0.1 mM NEAA, 2 mM L-glutamine, 1 mM sodium pyruvate, and 10 mM HEPES buffer. All cells were grown at 37° C. in a 5% $CO_2$ incubator. The human melanoma SK-MEL-28 cells were cultured in complete RPMI 1640 medium. For human monocyte-derived dendritic cell culture, complete RPMI 1640 was supplemented with 10 mM Hepes, 1% penicillin/streptomycin (Media Lab, MSKCC, New York, NY), 50 μM 2-ME (GibcoBRL Life Technologies, Carlsbad, CA), 1% L-glutamine (GibcoBRL), and heat-inactivated, normal human serum (1% or 10%, v/v as specified for a particular experiment; Gemini Bio-Products, West Sacramento, CA). Sterile, recombinant, endotoxin-, pyrogen-, mycoplasma-, and carrier-free human cytokines were used to generate immature and mature blood moDCs. All media and reagents were endotoxin-free. All cells were grown at 37° C. in a 5% CO2 incubator.

Mice. Female C57BL/6J mice between 6 and 10 weeks of age were purchased from the Jackson Laboratory and were used for in vivo experiments. These mice were maintained in the animal facility at the Sloan Kettering Institute. All procedures were performed in strict accordance with the recommendations in the Guide for the Care and Use of Laboratory Animals of the National Institute of Health. The protocol was approved by the Committee on the Ethics of Animal Experiments of Sloan-Kettering Cancer Institute.

Generation of recombinant MVAΔE3L-TK(−)-mOX40L virus. BHK21 cells were passaged into a 6-well plate. The next day, cells were infected with MVAΔE3L at multiplicity of infection (MOI) of 0.5. After 1-2 h, cells were transfected with 0.75 μg pCB-mOX40L-gpt construct with 2 μl lipofectamine 2000. After 2 days, cells were collected and freeze/thaw three times. To select pure MVAΔE3L-mOX40L, recombinant viruses were selected through further culturing in gpt selection medium including MPA, xanthine and hypoxanthine, and plaque purified after 4-6 rounds of selection. PCR analysis was performed to verify that MVAΔE3L-TK(−)-mOX40L lacks part of the TK gene and with mOX40L insertion.

POR verification of recombinant virus MVAΔE3L-mOX40L. PCR reactions were used to verify the purity of MVAΔE3L-TK(−)mOX40L recombinant virus. The primer sequences used for the PCR reactions are: TK-F4: 5'-TTGTCATCATGAACGGCGGA-3' (SEQ ID NO: 11), TK-R4: 5'-TCCTTCGTTTGCCATACGCT-3' (SEQ ID NO: 12), OX40L-F: 5'-CGTTGTAAGCGGCATCAAGG-3' (SEQ ID NO: 13), OX40L-R: 5'-AAGGCCAGTGAAGCGACTAC-3' (SEQ ID NO: 14).

FACS analysis of expression of mOX40L and hFlt3L. Murine B16-F10 melanoma cells ($1×10^6$) or SK-MEL-28 cells were infected with MVAΔE3L, MVAΔE3L-TK(−)-mOX40L, MVAΔC7L, MVAΔC7L-hFlt3L, or MVAΔC7L-hFlt3L-TK(−)-mOX40L at a MOI of 10. Cells were collected at 24 h post infection and stained with PE-conjugated anti-murine OX40L or anti-hFlt3L antibody prior to FACS analysis.

Tumor implantation and intratumoral injection with viruses for evaluation of tumor infiltrating lymphocytes by flow cytometry analysis. A bilateral tumor implantation model was used in this technology. B16-F10 melanoma cells were implanted intradermally into the shaved skin on the right ($5×10^5$ cells) and left ($2.5×10^5$ cells) flanks of a C57BL/6J mouse. After 7 days post implantation, the larger tumors on the right flank (about 3 mm or larger in diameter) were injected twice per week with recombinant viruses or PBS when the mice were under anesthesia. Two or three days after the second injection, tumors were harvested and weighed. They were then minced prior to incubation with Liberase (1.67 Wünsch U/ml) and DNase (0.2 mg/ml) in serum free RPMI medium for 30 minutes at 37° C. Cell suspensions were generated by mashing through a 70 μm nylon filter, and then washed with the complete RPMI medium. Cells were processed for surface labeling with anti-CD3, CD45, CD4, and CD8 antibodies, and also for intracellular Granzyme B staining. Live cells are distinguished from dead cells by using fixable dye eFluor506 (eBioscience, Thermo Fisher Scientific, Waltham, MA). They were further permeabilized using permeabilization kit (eBioscience, Thermo Fisher Scientific, Waltham, MA), and stained for Granzyme B. Data were acquired using the LSRII Flow cytometer (Becton-Dickinson Biosciences, Franklin Lakes, NJ). Data were analyzed with FlowJo software (FlowJo, Becton-Dickinson, Franklin Lakes, NJ).

IFN-γ ELISPOT assay. B16-F10 melanoma cells were implanted intradermally to the right ($5\times10^5$ cells) and left ($2.5\times10^5$ cells) flanks of C57B/6J mice. Seven days after tumor implantation, the tumors on the right flanks were injected with PBS, or recombinant viruses. The injections were repeated once 3 days later. Two or three days after the second injection, spleens were harvested from mice treated with different viruses, and were mashed through a 70 μm strainer (Thermo Fisher Scientific, Waltham, MA). Red blood cells were lysed using ACK Lysis Buffer (Life Technologies, Carlsbad, CA) and the cells were re-suspended in complete RPMI medium. $CD8^+$ T cells were purified using CD8α (Ly-2) MicroBeads from Miltenyi Biotechnology. Enzyme-linked ImmunoSpot (ELISPOT) assay was performed to measure tumor specific IFN-$\gamma^+$ $CD8^+$ T cell activities according to the manufacturer's protocol (Becton-Dickinson Biosciences, Franklin Lakes, NJ). $CD8^+$ T cells were mixed with irradiated B16 cells at 1:1 ratio (250,000 cells each) in RPMI medium, and the ELISPOT plate was incubated at 37° C. for 16 hours before staining.

Generation of recombinant MVAΔC7L-hFlt3L-TK(−)-mOX40L virus. Two-step recombination was used to generate this virus. The first step is to generate MVAΔC7L-hFlt3L. pUC57 vector was constructed to insert an expression cassette into the C7L locus of MVA, which includes hFlt3L gene under the vaccinia viral synthetic early and late promoter (PsE/L) and GFP under the control of the vaccinia P7.5 promoter used as a selection marker. This expression cassette was flanked by partial sequence of C8L and C6R on the left and right side of C7L gene. BHK21 cells were infected with MVA at a multiplicity of infection (MOI) of 0.5 for 1 h, and then were transfected with the plasmid DNAs described above. The infected cells were collected at 48 h. Recombinant viruses were selected by serial selection of $GFP^+$ foci. PCR analysis was performed to verify that MVAΔC7L-hFlt3L lacks the C7L gene and with hFlt3L insertion. The second step to generate MVAΔC7L-hFlt3L-TK(−)-mOX40L. The pCB plasmid containing a codon optimized mOX40L gene under the control of the vaccinia PsE/L as well as the *E. coli* xanthine-guanine phosphoribosyl transferase gene (gpt) under the control of vaccinia P7.5 promoter flanked by the thymidine kinase (TK) gene on either side was constructed. BHK21 cells were infected with MVAΔC7L-hFlt3L at a multiplicity of infection (MOI) of 0.5 for 1 h, and then were transfected with the plasmid DNAs described above. The infected cells were collected at 48 h. Recombinant viruses were selected through further culturing in gpt selection medium including MPA, xanthine and hypoxanthine, and plaque purified. PCR analysis was performed to verify that MVAΔC7L-hFlt3L-TK(−)-mOX40L lacks C7L gene and part of the TK gene, but with both hFlt3L and mOX40L insertion. MVAΔC7L-hFlt3L-TK (−) was also constructed with pCB plasmid containing gpt gene under the control of vaccinia P7.5 promoter flanked by the TK gene on either side. PCR analysis was performed to verify that MVAΔC7L-hFlt3L-TK(−) lacks C7L gene and part of the TK gene, but with hFlt3L insertion.

Bilateral tumor implantation model and intratumoral injection with recombinant MVAΔC7L-hFlt3L-TK(−)-mOX40L, in the presence or absence of immune checkpoint blockade. Briefly, B16-F10 melanoma cells were implanted intradermally to the left and right flanks of C57BL/6 mice ($5\times10^5$ to the right flank and $1\times10^5$ to the left flank). 9 days after tumor implantation, the larger tumors on the right flank were intratumorally injected with $2\times10^7$ pfu of MVAΔC7L-hFlt3L-TK(−)-mOX40L. Mice were also treated with intraperitoneal delivery of immune checkpoint blockade antibodies, including anti-CTLA-4 (100 μg per mouse per injection), or anti-PD-L1 (250 μg per mouse per injection) twice weekly. The tumor sizes were measured and the tumors were repeatedly injected twice a week. The survival of mice was monitored. Tumor volumes were calculated according the following formula: l (length)×w (width)×h (height)/2. Mice were euthanized for signs of distress or when the diameter of the tumor reached 10 mm.

Unilateral intradermal tumor implantation and intratumoral injection with viruses recombinant MVAΔC7L-hFlt3L-TK(−)-mOX40L in the presence or absence of immune checkpoint blockade for the treatment of large established tumors. B16-F10 melanoma ($5\times10^5$ cells) were implanted intradermally into the shaved skin on the right flank of WT C57BL/6J mice. After 9 days post implantation, when the tumors that are 5 mm in diameter, they will be injected with MVAΔC7L-hFlt3L-TK(−)-mOX40L ($5\times10^7$ pfu) or PBS when the mice were under anesthesia. Viruses were injected twice weekly. Mice were also treated with intraperitoneal delivery of immune checkpoint blockade antibodies, including anti-CTLA-4 (100 μg per mouse per injection), anti-PD-1 (250 μg per mouse per injection), or anti-PD-L1 (250 μg per mouse per injection) twice weekly. Tumor volumes were calculated according the following formula: l (length)×w (width)×h (height)/2. The survival of mice was monitored. Mice were euthanized for signs of distress or when the diameter of the tumor reached 10 mm.

Preparation of primary chicken embryo fibroblasts ((EF's). Day 9-11 days of chicken embryos from SPF eggs (Charles River, Cat# 10100326) were used. Embryos were minced by squeezing through a 10-cc syringe into a sterile 50 mL-EP tube. After digestion with 2.5% trypsin/EDTA at 37° C. for 5 min, cell suspensions were filtered through 70 μM Nylon strainer. Cells suspensions were pelleted, resuspended in complete MEM medium, and then cultured in T-75 flasks until the cell layer becomes confluent.

Multi-step growth in primary chicken embryo fibroblasts (CEF's). $5\times10^5$ CEF cells were seeded in a 6-well plate and were cultured overnight. Cells were infected with either MVA, MVAΔC7L-hFlt3L, MVAΔC7L-hFlt3L-TK(−)-mOX40L, or MVAΔC7L-hFlt3L-TK(−)-hOX40L at a MOI of 0.05 for one hour. The inoculum was removed and cells were washed with PBS once and incubated with fresh medium. Cells were collected at 1, 24, 48, and 72 h post infection. After three cycles of freezing and thawing, the samples were sonicated and virus titers were determined by serial dilution and infection of BHK21 cells. Confocal microscope was used to visualize $GFP^+$ foci for counting.

Generation of human monocyte-derived dendritic cells. All collection and use of human specimens adhered to protocols reviewed and approved by the Institutional Review and Privacy Board of Memorial Hospital, MSKCC. Buffy coats were obtained from healthy donors at New York Blood Center and peripheral blood mononuclear cells (PBMCs) separated by standard centrifugation over Ficoll- Paque PLUS (Amersham Pharmacia Biotech, Uppsala, Sweden). Tissue culture plastic adherent PBMCs comprised the moDCs precursors, which were cultured in complete RPMI 1640-1% human serum supplemented with GM-CSF (1000 IU/ml) and IL-4 (500 IU/ml). Fresh medium and cytokines were replenished every 48 h. Immature (day 6) moDCs were infected with Heat-iMVA, MVAΔC7L-hFlt3L-TK(−), or MVAΔC7L-hFlt3L-TK(−)-hOX40L at a MOI of 1, or treated with poly I:C at 10 μg/ml. Cells were collected at 24 h post treatment and stained with PE-conjugated anti-hOX40L antibody prior to FACS analyses.

Dual Luciferase Reporter assay. Luciferase activities were measured using the Dual Luciferase Reporter Assay system according to the manufacturer's instructions (Promega). Briefly, expression plasmids including a firefly luciferase reporter construct, a Renilla luciferase reporter construct, as well as other expression constructs were transfected into HEK293T cells. Murine cGAS (50 ng) and hSTING (10 ng) were used at suboptimal dosages for the purpose of identifying inhibitors. The transfected plasmids containing viral genes were used at 200 ng. IFNB-firefly luciferase reporter and control plasmid pRL-TK were used at 50 ng and 10 ng, respectively. 24 h post transfection, cells were collected and lysed. 20 μl cell lysates were incubated with 50 μl of LARII to measure firefly luciferase activity and then were incubated with 50 μl of Stop & Glo Reagent to measure Renilla luciferase activity. The relative luciferase activity was expressed as arbitrary units by normalizing firefly luciferase activity under IFNB or ISRE promoter to Renilla luciferase activity from a control plasmid pRL-TK. Fold-induction was calculated by dividing relative luciferase activity under a certain test condition by that under background condition.

Generation of retrovirus expressing vaccinia E5, K7, B14, B18. HEK293T cells were passaged into a 6-well plate. The next day, cells were transfected with three plasmids: VSVG (1 μg); gag/pol (2 μg); and PQCXIP-E5, K7, B14, B18 (2 μg), with 10 μl lipofectamine 2000. After 2 days, cell supernatants were collected and filtered through a 0.45 μm filter and stored in −80° C.

Generation of RAW264.7 cell line stably expressing vaccinia FLAG-tagged E5, K7, B14, or B18. RAW264.7 cells were passaged into a 6-well plate. The next day, cells were infected with retrovirus expressing E5, K7, B14, or B18 at MOI 5. After 2 days, culture medium was replaced with fresh DMEM medium containing 5 μg/ml puromycin. After one week, survival cells are the cells stably expressing FLAG-tagged E5, K7, B14, or B18. The expression of FLAG-tagged E5, K7, B14, or B18 was verified by Western blot analysis using anti-FLAG antibody.

RNA isolation and quantitative real-time PCR. RNA was extracted from whole-cell lysates with an RNeasy Mini kit (Qiagen) and was reverse transcribed with a First Strand cDNA synthesis kit (Fermentas). Quantitative real-time PCR was performed in triplicate with SYBR Green PCR Mater Mix (Life Technologies) and Applied Biosystems 7500 Real-time PCR Instrument (Life Technologies) using gene-specific primers. Relative expression was normalized to the levels of glyceraldehyde-3-phosphate dehydrogenase (GAPDH).

Reagents. The commercial sources for reagents were as follows: anti-hFlt3L antibody was purchased from Thermo Fisher and secondary antibody for anti-hFlt3L (PE-conjugated goat anti-mouse) was from BD Biosciences. PE-conjugated mOX40L and PE-conjugated anti-hOX40L antibody were purchased from Biosciences and R & D respectively. Anti-CD3, -CD45, -CD8, and-Granzyme B antibodies were purchased form eBioscience (Thermo Fisher Scientific, Waltham, MA). CD8α microbeads was from Miltenyi Biotechnology (Somerville, MA). ELISPOT assay kit was purchased from Becton-Dickinson Biosciences (Franklin Lakes, NJ). Therapeutic anti-CTLA4 (clone 9H10 and 9D9), anti-PD1 (clone RMP1-14), anti-PD-L1 (clone 10F.9G2) were purchased from BioXcell; Antibodies used for flow cytometry were purchased from eBioscience (CD45.2 Alexa Fluor 700, CD3 PE-Cy7, CD4 APC-efluor780, CD8 PerCP-efluor710), Invitrogen (CD4 QDot 605, Granzyme B PE-Texas Red, Granzyme B APC).

Statistics. Two-tailed unpaired Student's t test was used for comparisons of two groups in the studies. Survival data were analyzed by log-rank (Mantel-Cox) test. The p values deemed significant are indicated in the figures as follows: *, $P<0.05$; , $P<0.01$; *, $P<0.001$; ****, $P<0.0001$.

Generation of B2M, MDA5, STING knock-out cell lines. B16-F10 cells were transfected with 800 ng of Cas9 expression plasmid (obtained from Church lab through Addgene) and 800 ng of each gRNA expression plasmid using Lipofectamine 3000 reagent (Thermo Scientific). Cells were allowed to grow for at least 2 days after transfection. The success of CRISPR constructs was then tested. In the case of STING and MDA5 CRISPR, targeted exons were PCR-amplified from genome with specific primers and then digested with 2 units of T7 endonuclease (obtained from new England biolabs) for 90 minutes. After digestion, agarose gel electrophoresis was performed to determine whether T7 cleaved the PCR amplicons, indicating successful CRISPR. After confirmation of gRNA efficacy, individual cells were seeded onto 96-well plates and expanded into clonal isolates. After expansion, clonal isolates were screened using another round of PCR amplification and T7 digestion. Subsequent Western Blot analysis confirmed loss of targeted proteins (STING or MDA5). In the case of Beta 2 Microglobulin (B2M) CRISPR, FACS analysis was used to verify successful CRISPR before sorting of B2M deficient cells onto 96 well plates and expanded into clonal isolates.

Human tumor tissues from patients with Extramammary Paget Disease (EMPD)). Human tumor tissues were obtained from patients with Extramammary Paget disease (EMPD) enrolled in IRB-approved clinical protocol 06-107 at Memorial Sloan Kettering Cancer Center. 3-4 mm punch biopsy was performed by the clinician in the clinic. The tumor tissues were transported to the laboratory in RPMI medium on ice. Once they arrived in the lab, they were cut into small pieces with a scalpel and infected with MVAΔE5R-hFlt3L-hOX40L at a MOI of 10. 48 h post infection, tissues were digested with collagenase D at 37° C. for 45 min. Then they were filtered and stained with surface antibody for CD3, CD4, and CD8. After that, they were permeabilized and stained with antibodies for Granzyme B and Foxp3.

Example 1: Generation of recombinant MVAΔE3L with a TK-deletion expressing murine OX40L.

Figure 2A:
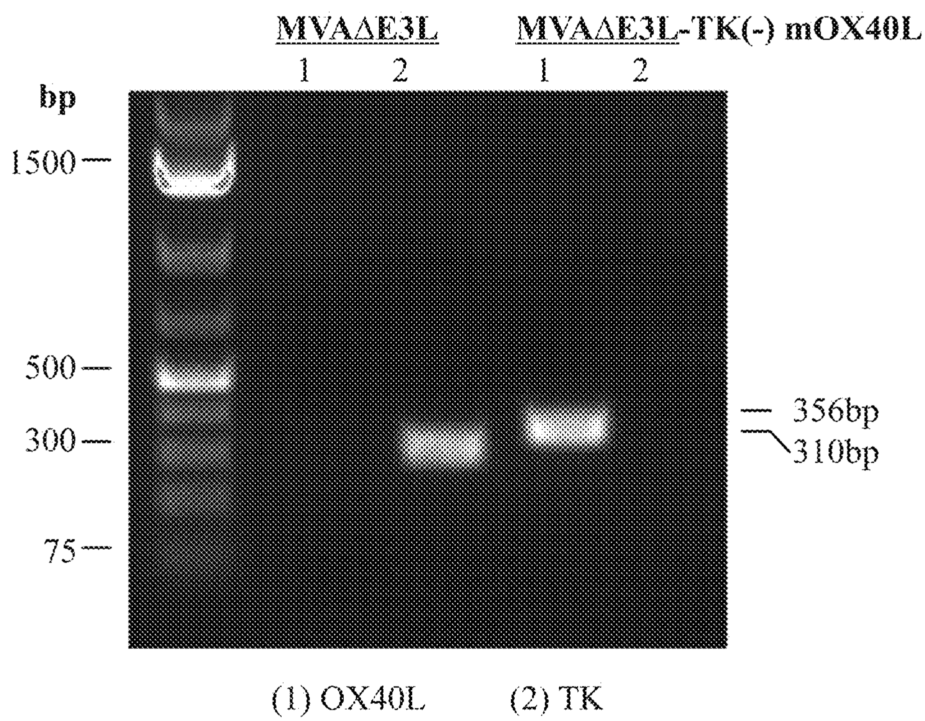
FIGS. 2A-2B show the verification of OX40L expression from recombinant virus MVAΔE3L-TK(−)-mOX40L.
Figure 2B:
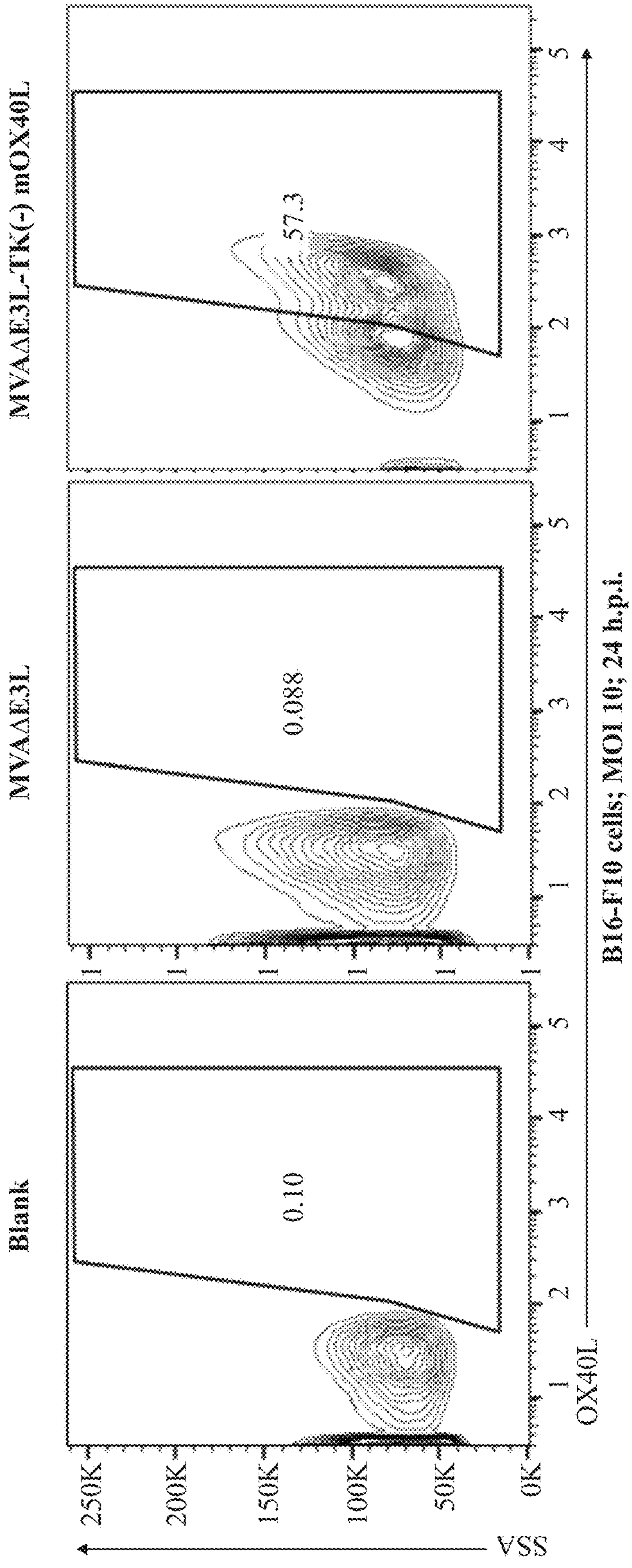
Figure 3A:
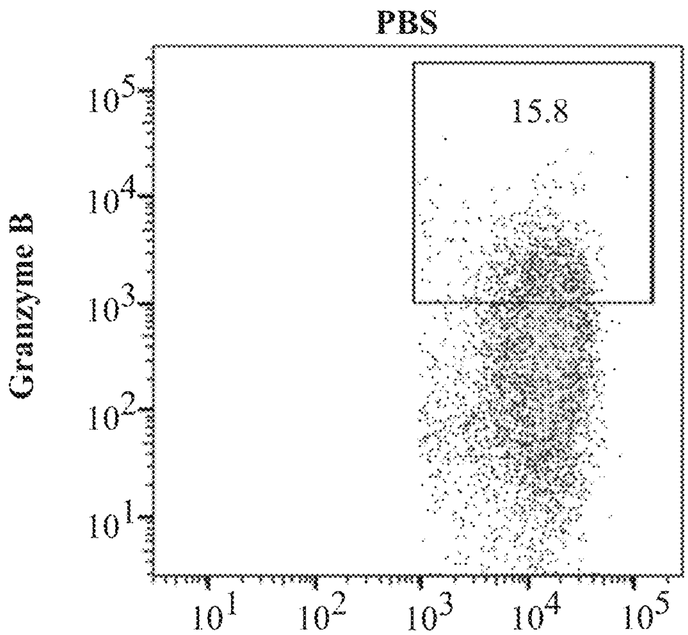
FIGS. 3A-3H are a series of graphical representations of data showing that intratumoral injection of MVAΔE3L-OX40L generated more activated tumor-infiltrating effector T cells in distant tumors compared with MVAΔE3L in B16-F10 bilateral tumor model. B16-F10 murine melanoma bilateral tumor implantation model was used. Briefly, B16-F10 melanoma cells were implanted intradermally to the left and right flanks of C57B/6J mice ($5\times10^5$ to the right flank and $2.5\times10^5$ to the left flank). Seven days post tumor implantation, $2\times10^7$ pfu of either MVAΔE3L, MVAΔE3L-OX40L, or PBS was intratumorally (IT) injected into the larger tumors on the right flank twice, three days apart. Tumors were harvested at 2 days post second injection and tumor infiltrating lymphocytes were analyzed by FACS.
Figure 3B:
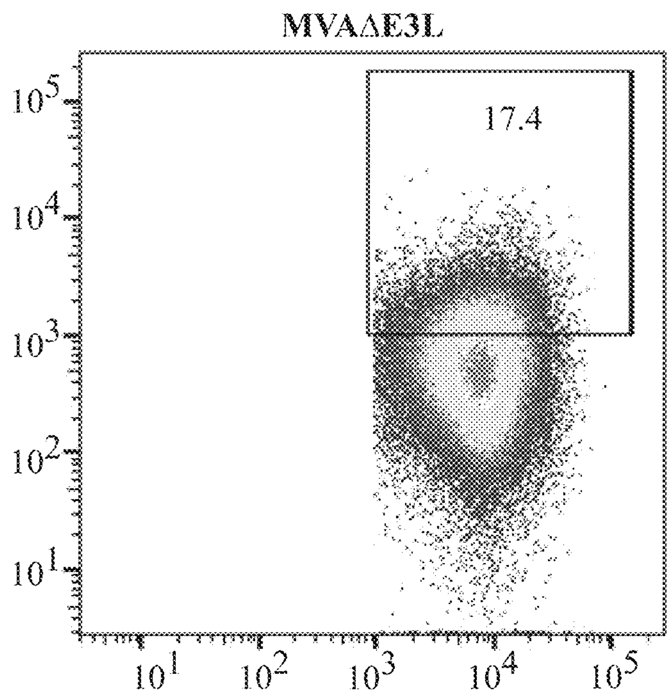
Figure 3C:
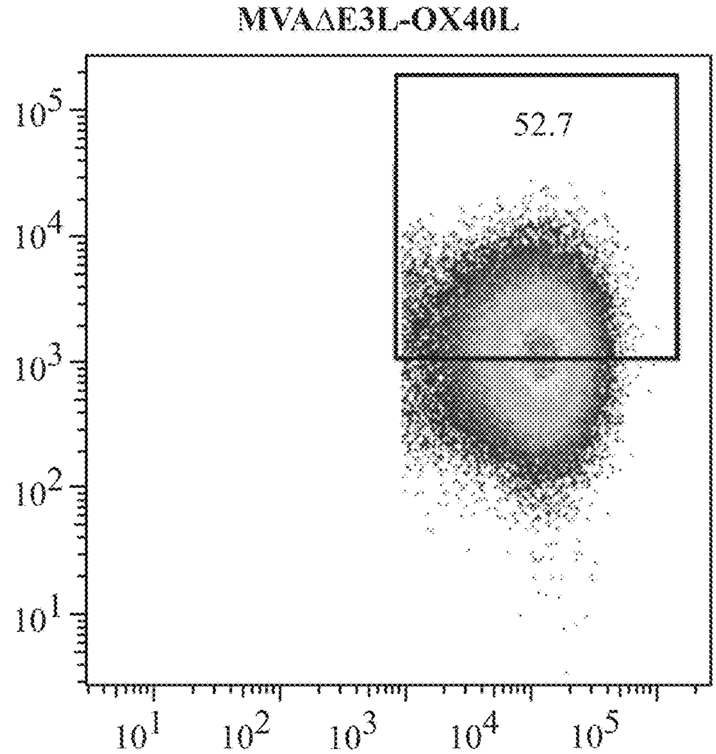
Figure 3D:
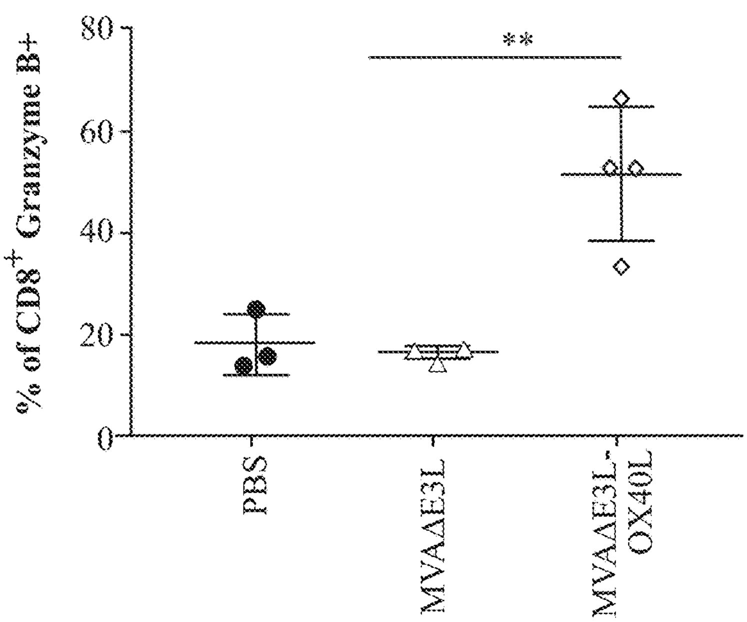
Figure 3E:
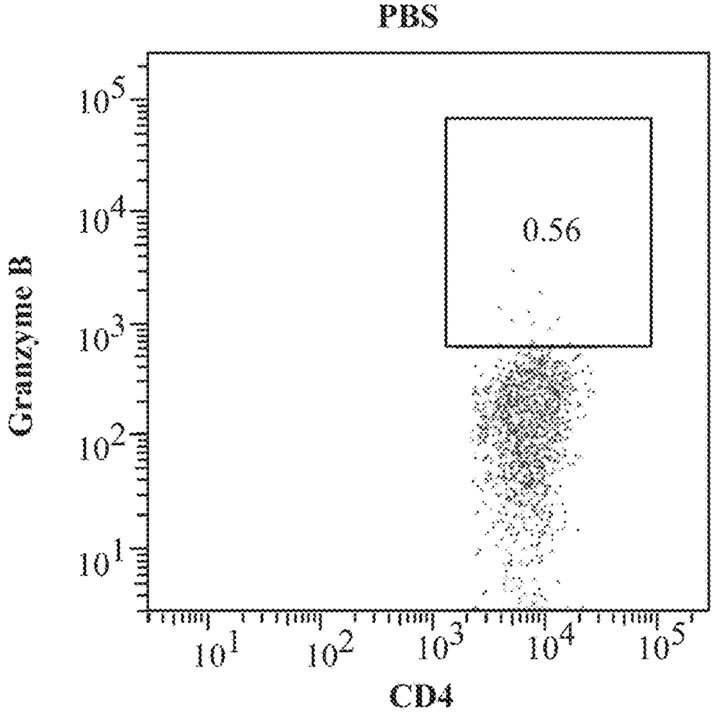
Figure 3F:
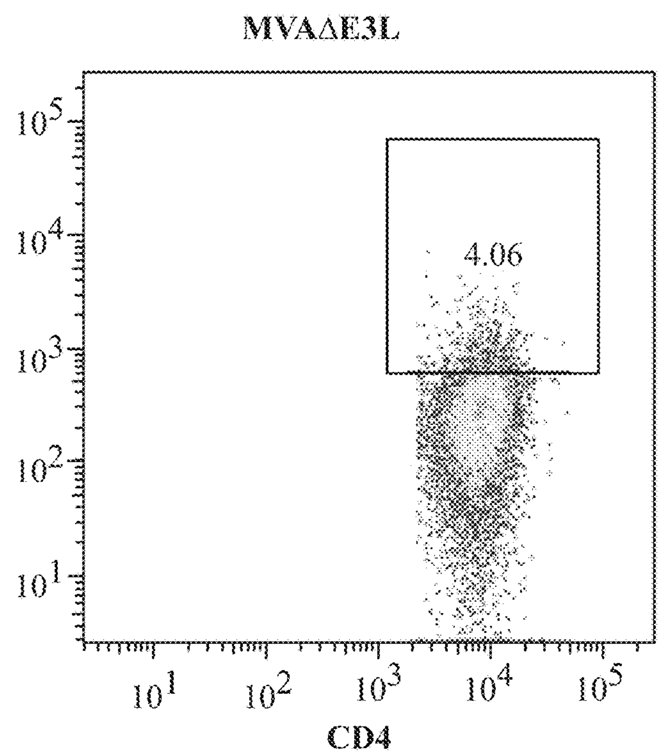
Figure 3G:
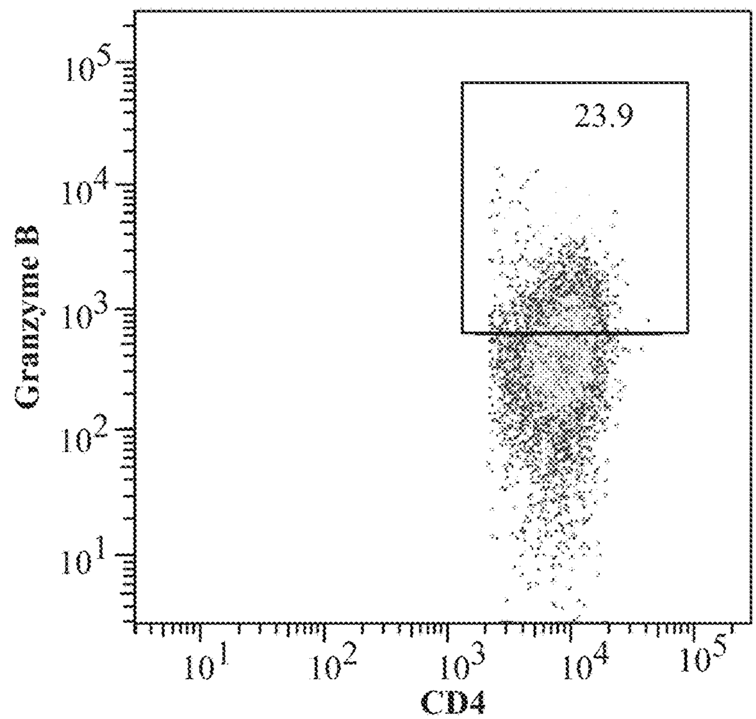
Figure 3H:
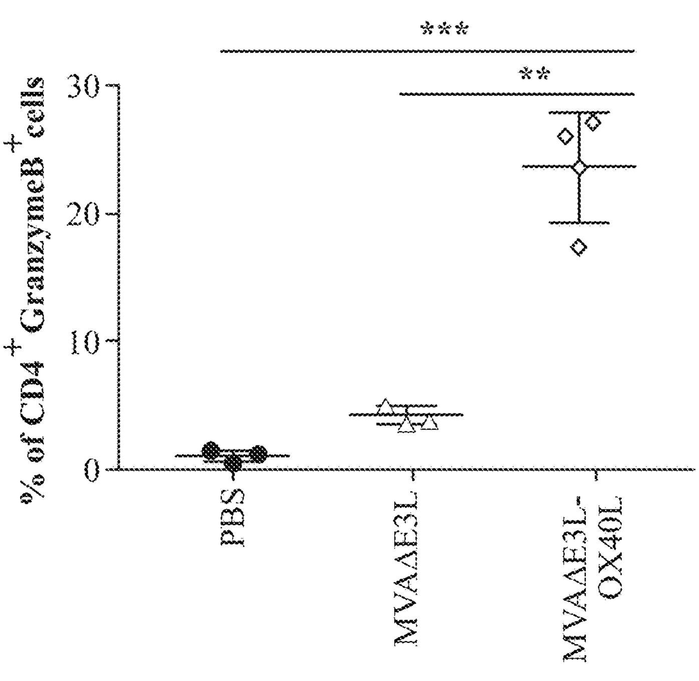

This example describes the generation of a recombinant vaccinia MVAΔE3L virus comprising a TK-deletion expressing murine OX40L (mOX40L). FIG. 1 shows the schematic diagram of an expression cassette designed to express mOX40L using the vaccinia viral synthetic early and late promoter (PsE/L). A plasmid containing a codon optimized mOX40L gene under the control of the vaccinia PsE/L as well as the *E. coli* xanthine-guanine phosphoribosyl transferase gene (gpt) under the control of vaccinia P7.5 promoter flanked by the thymidine kinase (TK) gene on either side was constructed using standard recombinant virus technology through homologous recombination at the TK locus between pCB plasmid DNA and viral genomic DNA (FIG. 1). BHK21 cells were infected with MVAΔE3L at a multiplicity of infection (MOI) of 0.5) for 1 h, and then were transfected with the plasmid DNAs described above. The infected cells were collected at 48 h. Recombinant viruses were selected through further culturing in gpt selection medium including MPA, xanthine and hypoxanthine, and plaque purified. PCR analysis was performed to verify that MVAΔE3L-TK(−)-mOX40L lacks part of the TK gene and with mOX40L insertion (FIG. 2A). The expression of mOX40L on B16-F10 cells infected with MVAΔE3L-TK(−)-mOX40L virus was determined by FACS analysis using anti-mOX40L antibody (FIG. 2B). Briefly, B16-F10 cells were infected with MVAΔE3L-TK(−)-mOX40L at a MOI of 10. At 24 h post infection, cells were stained with PE-conjugated anti-mOX40L antibody. The expression of mOX40L on the surface of infected cells were evaluated by FACS analysis. FIG. 2B shows that the majority of the infected cells express mOX40L.

Example 2: Intratumoral injection of MVAΔE3L-TK(−)-mOX40L results in more activated tumor-infiltrating effector T cells in distant tumors compared with MVAΔE3L in B16-F10 bilateral tumor implantation model.

To assess whether intratumoral injection of MVAΔE3L-TK(−)-mOX40L or MVAΔE3L in B16-F10 melanomas leads to activation and proliferation of $CD8^+$ and $CD4^+$ T cells, a bilateral tumor implantation model was used. B16-F10 melanoma cells were implanted intradermally into the shaved skin on the right ($5\times10^5$ cells) and left ($2.5\times10^5$ cells) flanks of a C57BL/6J mouse. After 7 days post implantation, the larger tumors on the right flank (about 3 mm or larger in diameter) were injected twice per week with PBS, MVAΔE3L, MVAΔE3L-TK(−)-mOX40L when the mice were under anesthesia. Three days after the second injection, tumors were harvested and cells were processed for surface labeling with anti-CD3, CD45, CD4, and CD8 antibodies, and also for intracellular Granzyme B staining. The live immune cell infiltrates in the non-injected tumors were analyzed by FACS. There was a dramatic increase in $CD8^+$ T cells expressing Granzyme B in the non-injected tumors, from 18% in tumors of PBS-treated mice and 17% in tumors of MVAΔE3L-treated mice to 53% in the tumors of MVAΔE3L-TK(−)-mOX40L-treated mice (FIG. 3A-D). There was also a significant increase in $CD4^+$ T cells expressing Granzyme B in the non-injected tumors after intratumoral virus treatment, from 0.6% in tumors of PBS-treated mice to 4.3% in MVAΔE3L-treated mice to 24% in the tumors of MVAΔE3L-TK(−)-mOX40L-treated mice (FIG. 3E-H). These results demonstrate that intratumoral injection of the recombinant MVAΔE3L-TK(−)-mOX40L is more potent than its parental virus MVAΔE3L in inducing cytotoxic $CD8^+$ T cells and/or $CD4^+$ T cells within non-injected tumors.

Example 3: Intratumoral injection with MVAΔE3L-TK(−)-mOX40L leads to the generation of systemic antitumor $CD8^+$ T-cell immunity.

Figure 4A:
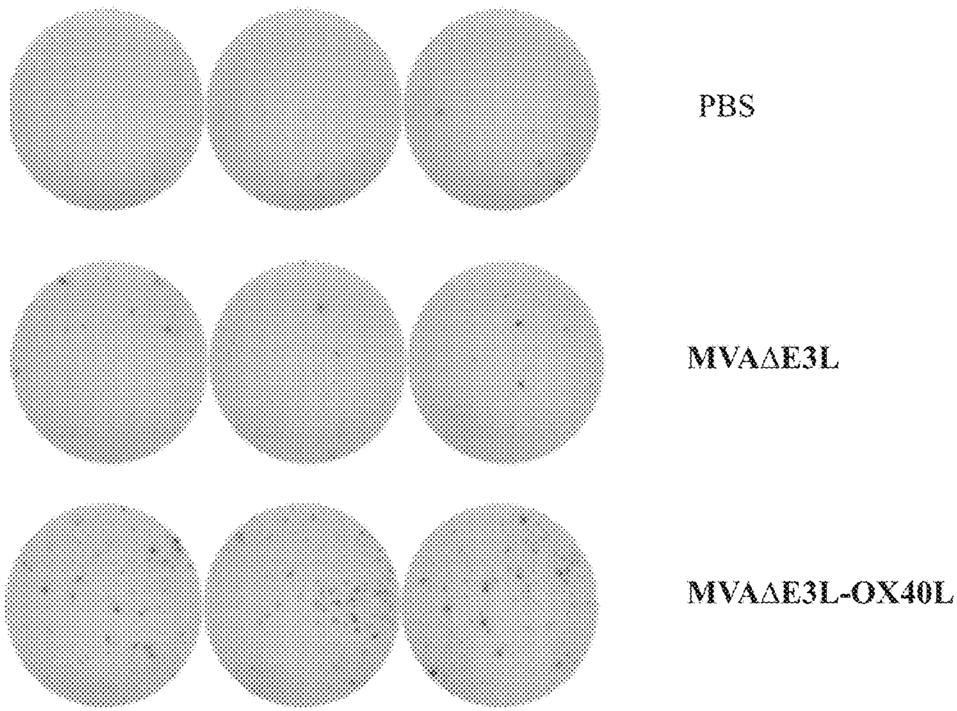
FIGS. 4A and 4B are representative ELISPOT blots and graph showing that IT injection of MVAAE3L-OX40L generated more antitumor CD8+ T cells in the spleens compared with MVA. B16-F10-bearing mice were treated with IT injection of either MVAΔE3L, MVAΔE3L-hFlt3L at $2\times10^7$ pfu, or PBS twice, three days apart. Spleens were collected at 2 days after second injection. ELISPOT assay was performed by co-culturing irradiated B16-F10 cells (150,000) and purified $CD8^+$ T cells (300,000) in a 96-well plate.
Figure 4B:
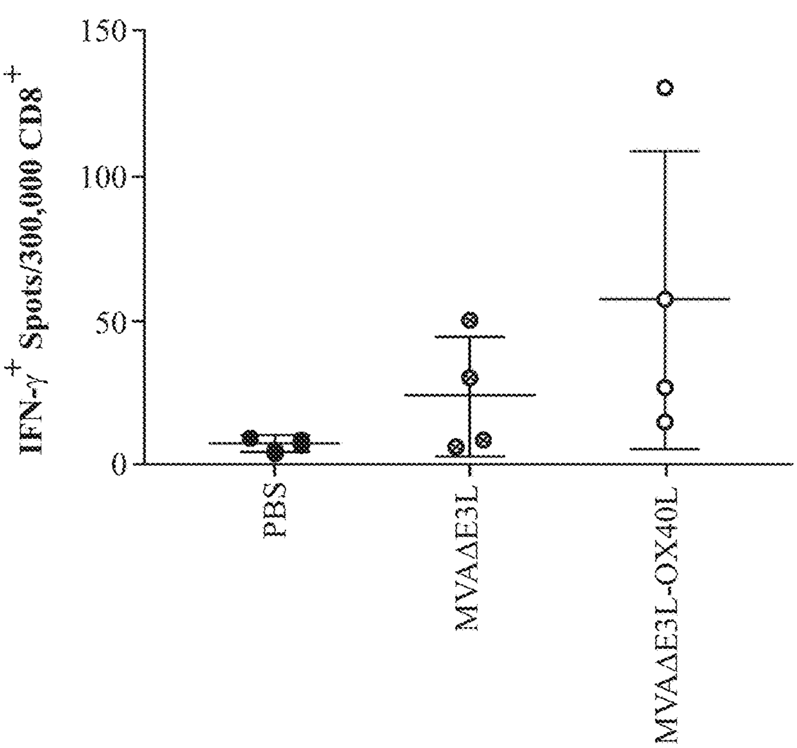

To assess whether mice gained systemic antitumor T-cell immunity against the murine B16-F10 melanoma cancer after treatment with intratumoral injection of MVAΔE3L-TK(−)-mOX40L or MVAΔE3L, Enzyme-linked ImmunoSpot (ELISpot) was used. B16-F10 cells ($5\times10^5$ and $2.5\times10^5$, respectively) were intradermally implanted into the shaved skin on the right and left flank of C57BL/6J mice. Seven days after tumor implantation the tumors on the right flank (about 3 mm in diameter) were injected with PBS, MVAΔE3L, or MVAΔE3L-TK(−)-mOX40L. The injections were repeated three days later, followed by euthanization three days after the second injection. ELISpot was performed to assess the generation of antitumor specific $CD8^+$ T cells in the spleens of mice treated with the recombinant viruses. Briefly, $CD8^+$ T cells were isolated from splenocytes and $3\times10^5$ cells were cultured with $1.5\times10^5$ irradiated B16-F10 cells overnight at 37° C. in anti-IFN-γ-coated BD ELISpot plate microwells. $CD8^+$ T cells were stimulated with B16-F10 cells irradiated with an γ-irradiator and IFN-γ secretion was detected with an anti-IFN-γ antibody. FIG. 4A shows representative images of IFN-$\gamma^+$ spots per 300,000 $CD8^+$ T cells from individual mouse treated with either PBS, MVAΔE3L, or MVAΔE3L-TK(−)-mOX40L. FIG. 4B shows the numbers of IFN-$\gamma^+$ spots per 300,000 $CD8^+$ T cells from individual mouse in each group treated with either PBS, MVAΔE3L, or MVAΔE3L-TK(−)-mOX40L. These results demonstrate that intratumoral injection of MVAΔE3L-TK(−)-mOX40L is more effective than MVAΔE3L in generating antitumor $CD8^+$ T cells in treated mice in a murine B16-F10 melanoma bilateral implantation model. Accordingly, these results demonstrate that the recombinant MVAΔE3L-TK(−)-mOX40L of the present technology are effective in enhancing or promoting an immune response in the subject and in increased cytotoxic $CD8^+$ T cells within of a subject.

Example 4: Generation of recombinant MVAΔC7L with a TK-deletion expressing murine OX40L.

Figure 5C:
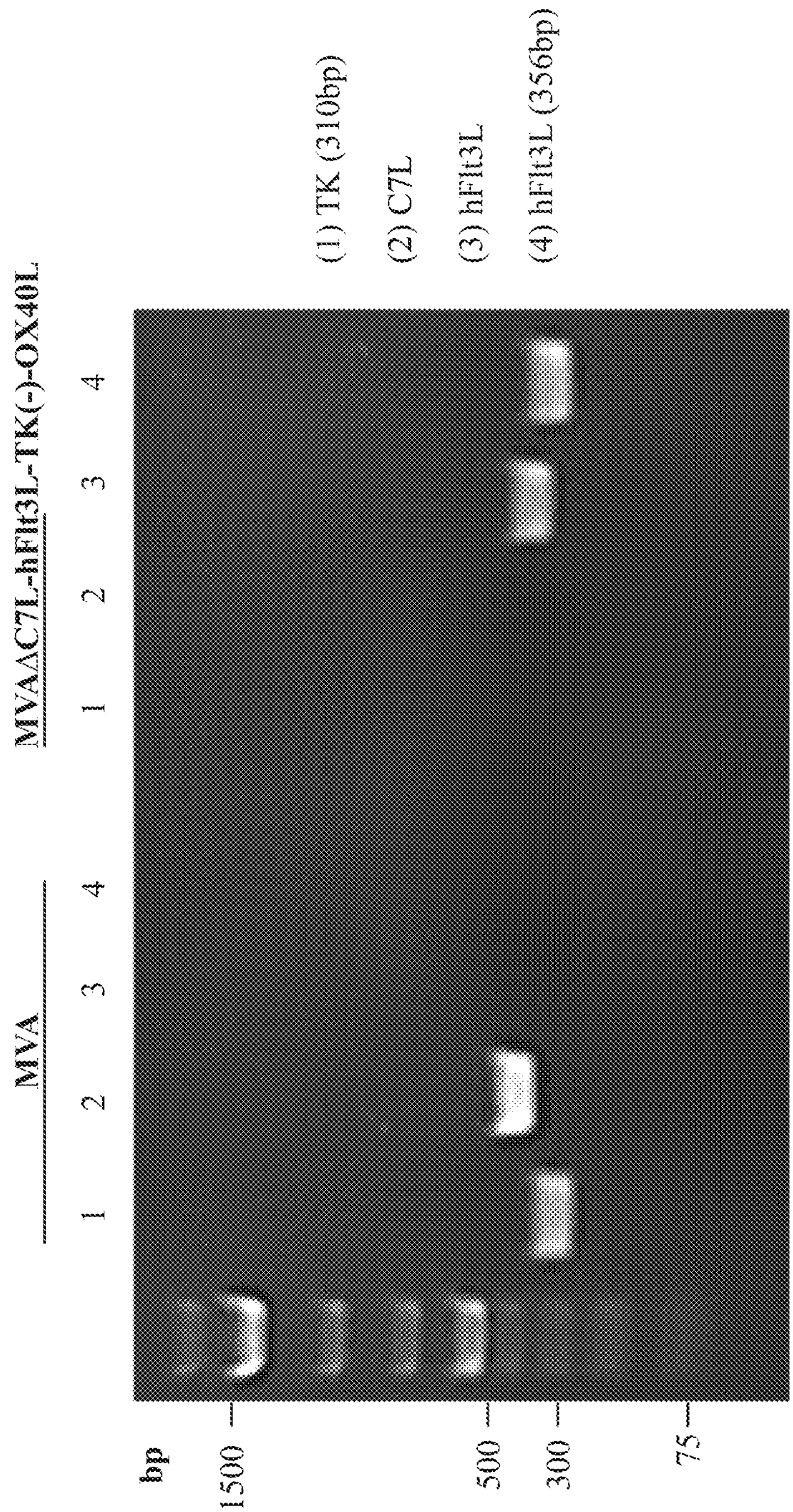
FIG. 5C shows that viral genomic DNAs were analyzed by PCR to verify the expression of OX40L and hFlt3L and confirm the insertion of the transgenes.
Figure 6:
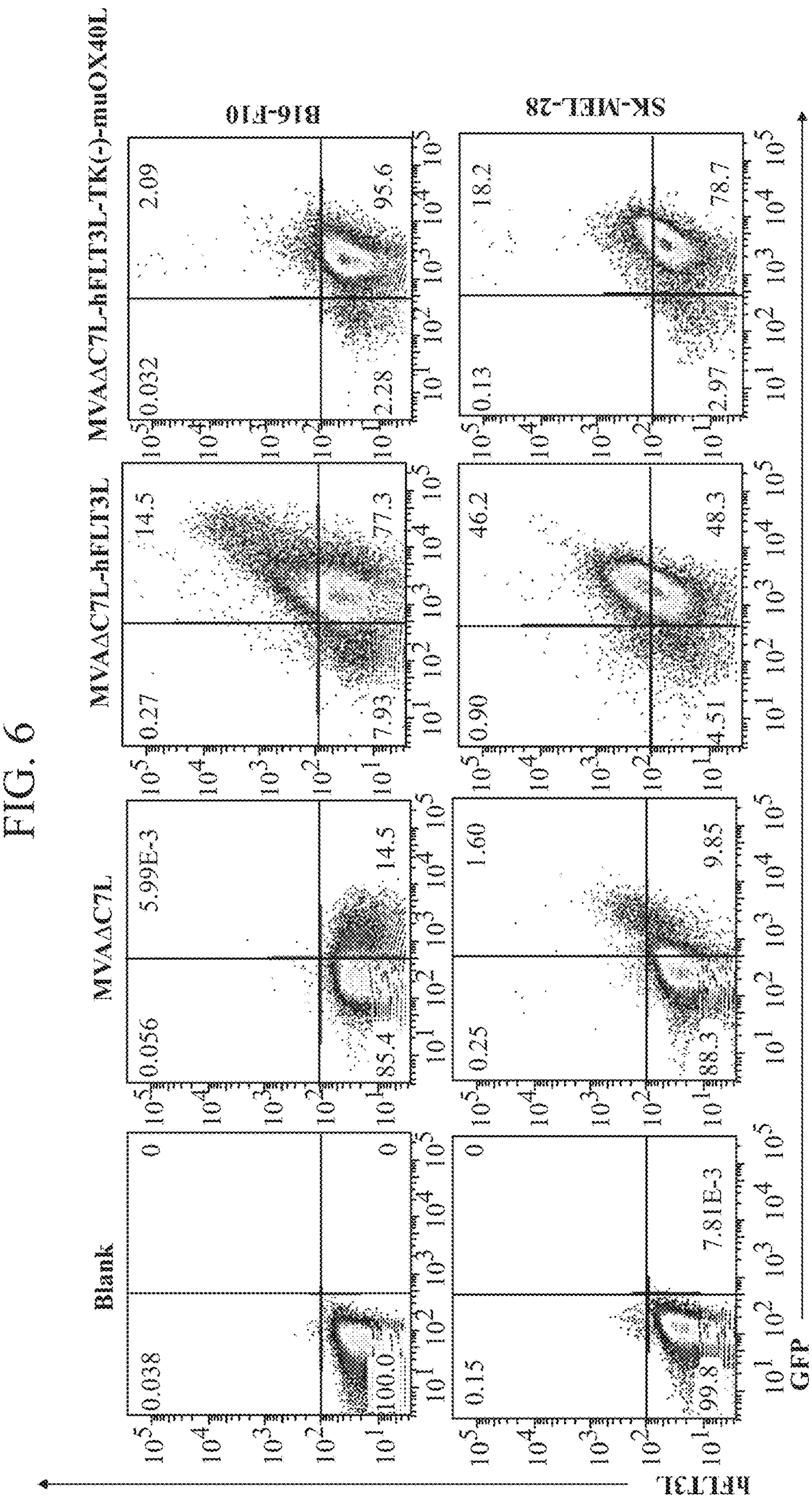
FIG. 6 are a series of dot plots from FACS analysis demonstrating hFl3L expression in B16-F10 and SK-MEL-28 cell lines infected with either MVAΔC7L-hFl3L or MVAΔC7L-hFlt3L-TK(−)-muOX40L. Cells were infected at a MOI of 10 for 24 hours prior to antibody staining and FACS analysis. MVAΔC7L, MVAΔC7L-hFlt3L or MVAΔC7L-hFlt3L-TK(−)-muOX40L-infected cells expressed GFP marker.
Figure 7:
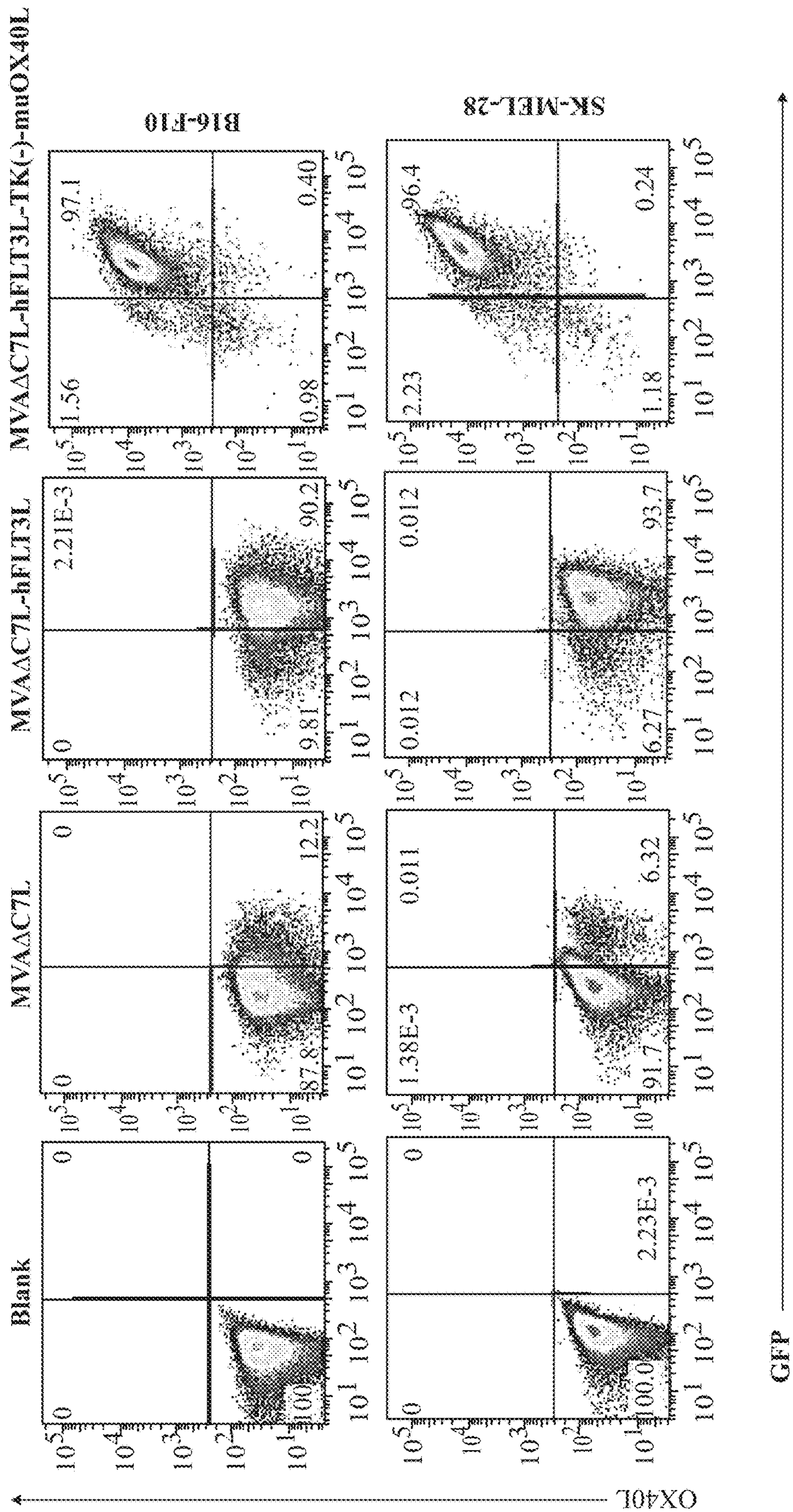
FIG. 7 are a series of dot plots from FACS analysis demonstrating murine OX40L expression in B16-F10 and SK-MEL-28 cell lines infected with MVAΔC7L-hFlt3L-TK(−)-muOX40L. Cells were infected at a MOI of 10 for 24 hours prior to antibody staining and FACS analysis.

This example describes the generation of a recombinant vaccinia MVAΔC7L virus comprising a TK-deletion expressing murine OX40L (mOX40L). FIG. 5A shows the first step to generate MVAΔC7L-hFl3L. pUC57 vector was constructed to insert a specific gene of interest (SG) into the C7L C7Llocus of MVA, which includes an expression cassette designed to express hFl3L using the vaccinia viral synthetic early and late promoter (PsE/L) and GFP under the control of the vaccinia P7.5 promoter used as a selection marker. The expression cassette was flanked by partial sequence of C8L and C6R on the left and right side of C7L gene (FIG. 5A). BHK21 cells were infected with MVA at a multiplicity of infection (MOI) of 0.5 for 1 h, and then were transfected with the plasmid DNAs described above. The infected cells were collected at 48 h. Recombinant viruses were selected by serial selection of $GFP^+$ foci. PCR analysis was performed to verify that MVAΔC7L-hFl3L lacks the C7L gene and with hFl3L insertion (data not shown). FIG. 5B shows the second step to generate MVAΔΔC7L-hFl3L-TK(−)-mOX40L. A plasmid containing a codon optimized mOX40L gene under the control of the vaccinia PsE/L as well as the *E. coli* xanthine-guanine phosphoribosyl transferase gene (gpt) under the control of vaccinia P7.5 promoter flanked by the thymidine kinase (TK) gene on either side was constructed. BHK21 cells were infected with MVAΔC7L-hFl3L at a multiplicity of infection (MOI) of 0.5 for 1 h, and then were transfected with the plasmid DNAs described above. The infected cells were collected at 48 h. Recombinant viruses were selected through further culturing in gpt selection medium including MPA, xanthine and hypoxanthine, and plaque purified. PCR analysis was performed to verify that MVAΔC7L-hFlt3L-TK(−)-mOX40LC7LhFl3LmOX40Llacks C7L C7Lgene and part of the TK gene, but with both hFl3L and mOX40L insertion. By contrast, the parental MVA genome contains C7L C7Land TK gene as expected (FIG. 5C). The expression of mOX40L on murine B16-F10 cells and human SK-MEL-28 cells infected with MVAΔC7L-TK(−)-mOX40L virus was determined by FACS analysis using anti-hFl3L antibody (FIG. 6) and anti-mOX40L antibody (FIG. 7). The majority of both murine B16-F10 and SK-MEL28 cells had high expression levels of mOX40L (FIG. 7).

Example 5: Intratumoral (IT) injection of MVAΔC7L-hFlt3L-TK(−)-mOX40L leads to recruitment of activated $CD8^+$ and $CD4^+$ T cells into the non-injected distant tumors in B16-F10 bilateral tumor implantation model.

Figure 8A:
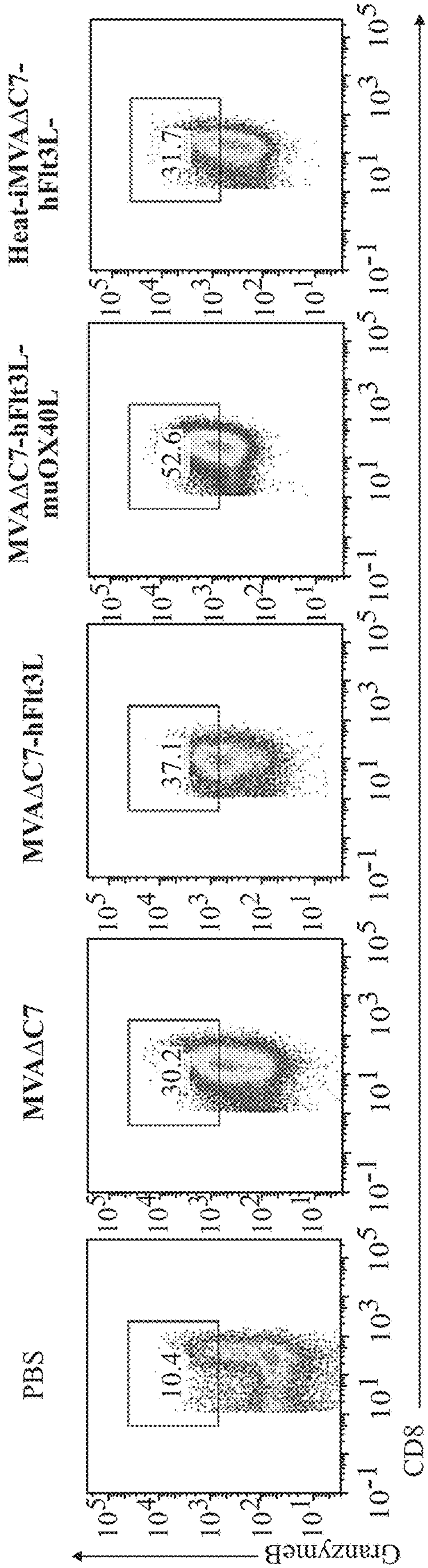
FIGS. 8A-8C are a series of graphical representations of data showing that intratumoral injection of MVAΔC7L-hFlt3L-TK(−)-muOX40L generated more activated tumor-infiltrating effector $CD8^+$ T cells in distant tumors compared with MVAΔC7L, MVAΔC7L-hFlt3L, or Heat-inactivated MVAΔC7L-hFlt3L in a B16-F10 bilateral murine melanoma model. Briefly, B16-F10 melanoma cells were implanted intradermally to the left and right flanks of C57B/6J mice ($5\times10^5$ to the right flank and $2.5\times10^5$ to the left flank). Seven days post tumor implantation, intratumoral (IT) injections ($2\times10^7$ pfu) of either MVAΔC7L-hFlt3L-TK(−)-muOX40L, MVAΔC7L, MVAΔC7L-hFlt3L, or Heat-inactivated MVAΔC7L-hFlt3L were performed to the larger tumors on the right flank twice, three days apart. The non-injected distant tumors were harvested at 2 days post second injection and tumor-infiltrating lymphocytes were analyzed by FACS.
Figure 8B:
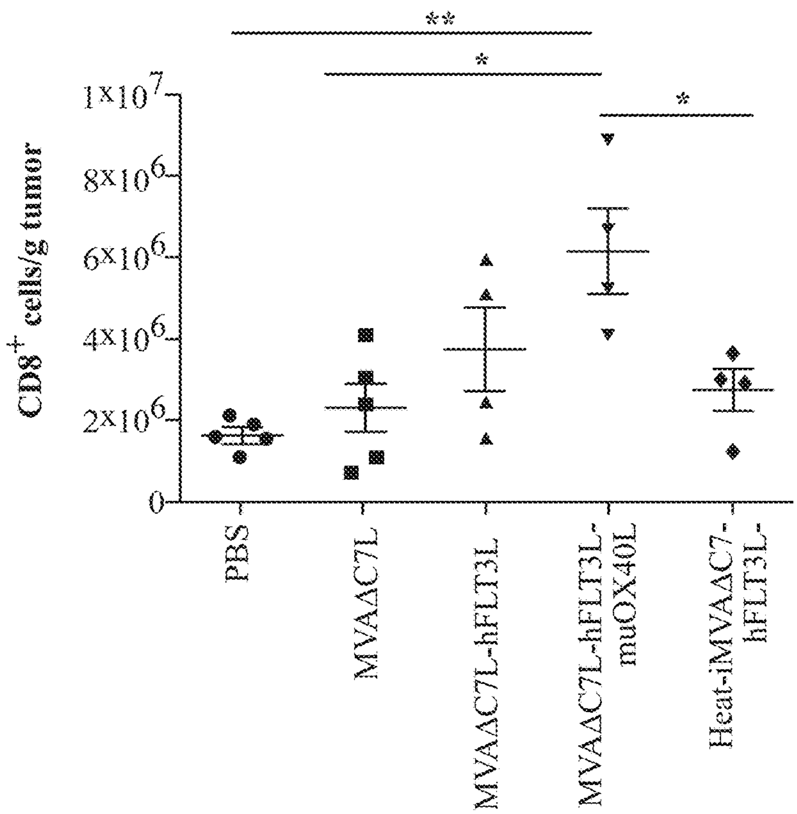
Figure 8C:
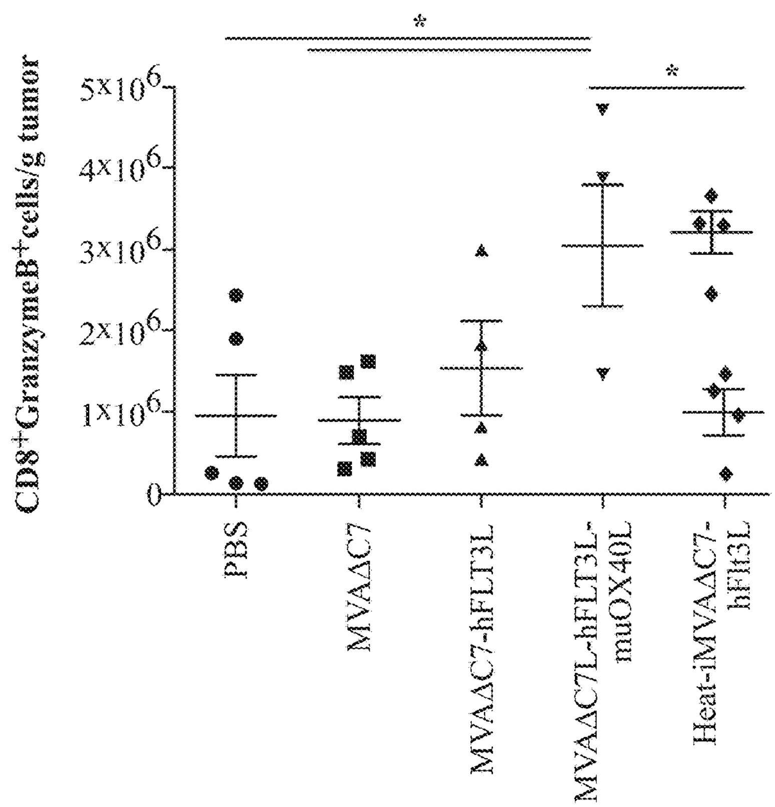
Figure 9A:
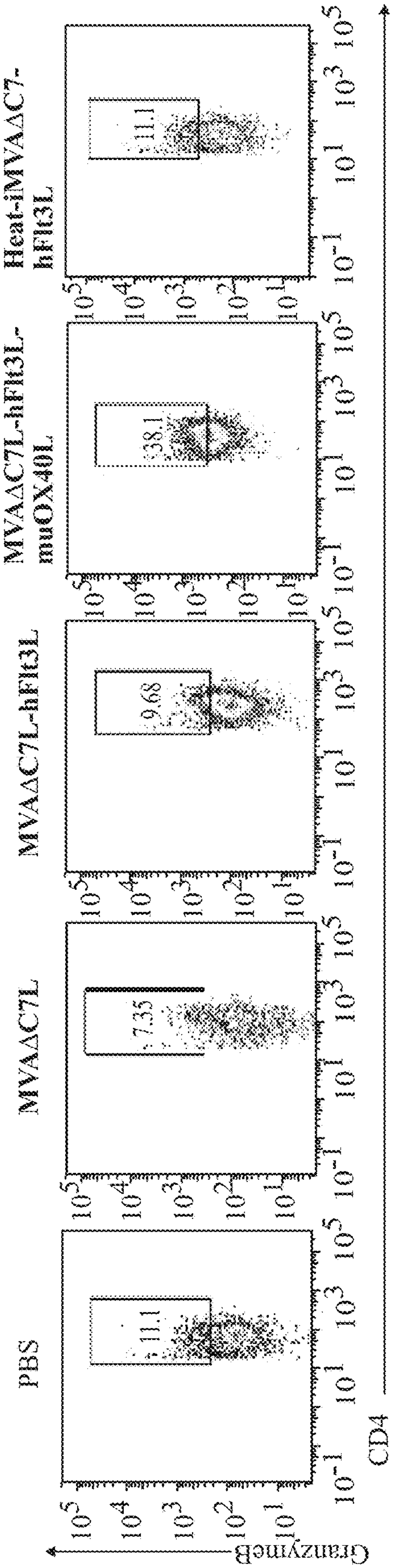
FIGS. 9A-9C are a series of graphical representations of data showing that intratumoral injection of MVAΔC7L-hFlt3L-TK(−)-muOX40L generated more activated tumor-infiltrating effector $CD4^+$ T cells in distant tumors compared with MVAΔC7L, MVAΔC7L-hFlt3L, or Heat-inactivated MVAΔC7L-hFlt3L in a B16-F10 bilateral murine melanoma model. Briefly, B16-F10 melanoma cells were implanted intradermally to the left and right flanks of C57B/6J mice ($5\times10^5$ to the right flank and $2.5\times10^5$ to the left flank). Seven days post tumor implantation, intratumoral (IT) injections ($2\times10^7$ pfu) of either MVAΔC7L-hFlt3L-TK(−)-muOX40L, MVAΔC7L, MVAΔC7L-hFlt3L, or Heat-inactivated MVAΔC7L-hFlt3L were performed to the larger tumors on the right flank twice, three days apart. The distant non-injected tumors were harvested at 2 days post second injection and tumor-infiltrating lymphocytes were analyzed by FACS.
Figure 9B:
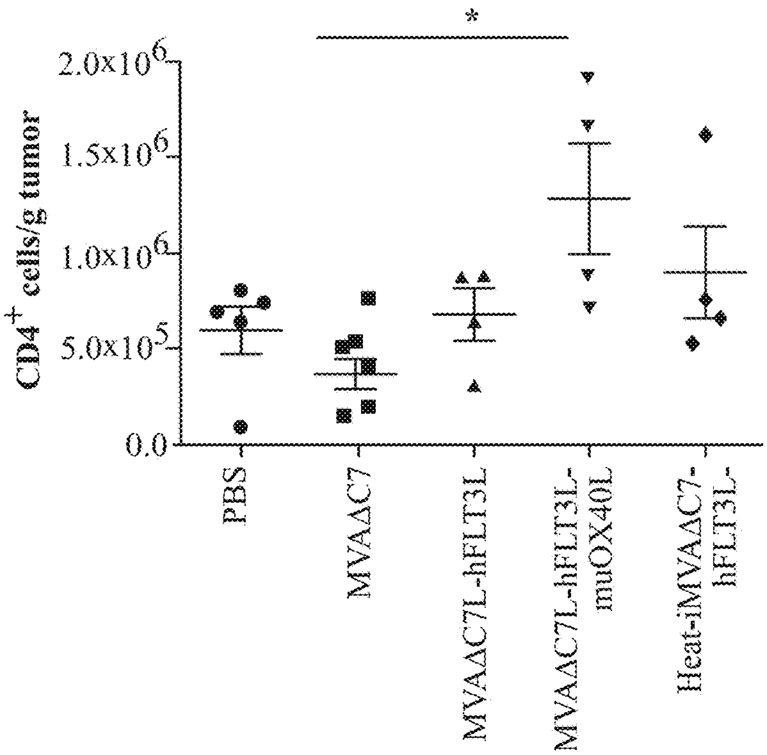
Figure 9C:
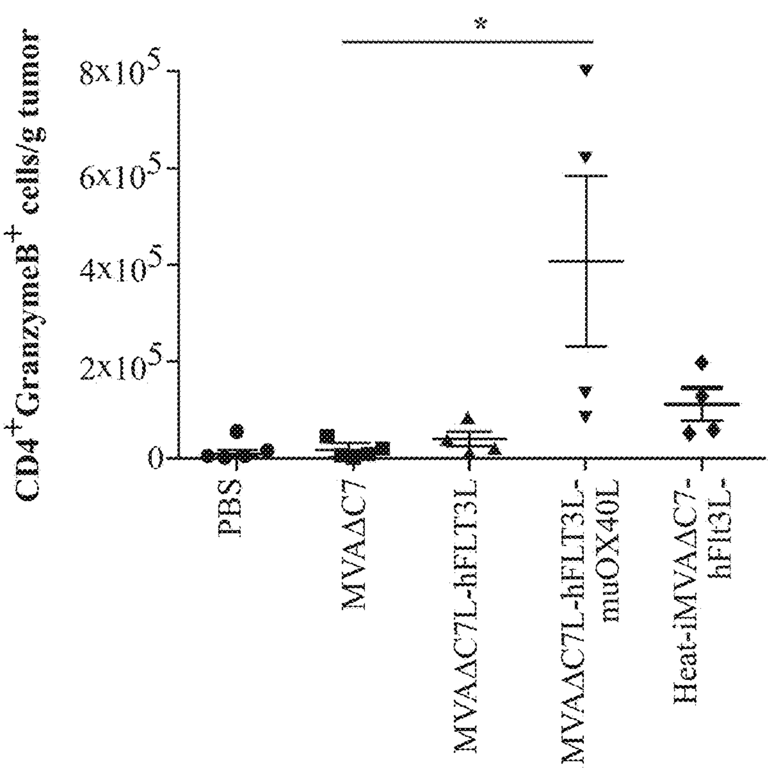

To assess whether IT MVAΔC7L-hFlt3L-TK(−)-mOX40L results in the generation of systemic antitumor immunity, a bilateral B16-F10 tumor implantation model was used. Briefly, B16-F10 melanoma cells were implanted intradermally into the shaved skin on the right ($5\times10^5$ cells) and left ($2.5\times10^5$ cells) flanks of a C57BL/6J mouse. After 7 days post implantation, the larger tumors on the right flank were injected twice per week with PBS, MVAΔC7L, MVAΔC7L-hFlt3L, or MVAΔC7L-hFlt3L-TK(−)-mOX40L at a MOI of $2\times10^7$ pfu, or with an equivalent amount of Heat-inactivated MVAΔC7L-hFlt3L (Heat-iMVAΔC7L-hFlt3L). Two days after the second injection, tumors were harvested and cells were processed for surface labeling with anti-CD3, CD45, CD4, and CD8 antibodies, and also for intracellular Granzyme B staining. The live immune cell infiltrates in the non-injected tumors were analyzed by FACS. IT MVAΔC7L-hFlt3L-TK(−)-mOX40LC7LhFl3LmOX40Lresulted in the highest number of total $CD8^+$ T cells per gram of tumor as well as total Granzyme $B^+$ $CD8^+$ T cells per gram of tumor in the non-injected tumors compared with the other treatment groups (FIGS. 8A-8C). Remarkably, IT MVAΔC7L-hFlt3L-TK(−)-mOX40LC7LhFl3LmOX40Lresulted in the highest number of total $CD4^+$ T cells per gram of tumor as well as total Granzyme $B^+$ $CD4^-$ T cells per gram of tumor in the non-injected tumors compared with the other treatment groups (FIGS. 9A-9C). These results demonstrate that IT MVAΔC7L-hFlt3L-TK(−)-mOX40LC7LhFl3LmOX40L is more effective than its parental virus MVAΔC7L C7Lor MVAΔC7L-hFl3L in inducing cytotoxic $CD8^+$ T cells and $CD4^+$ T cells within non-injected tumors. In addition, this engineered recombinant MVA is more potent than the inactivated MVAΔC7L-hFl3L in inducing anti-tumor $CD8^+$ and $CD4^+$ T cell responses.

Example 6: IT injection of MVAΔC7L-hFlt3L-TK(−)-mOX40L leads to the strongest systemic antitumor $CD8^+$ T-cell immunity compared with MVAΔC7L.

Figure 10A:
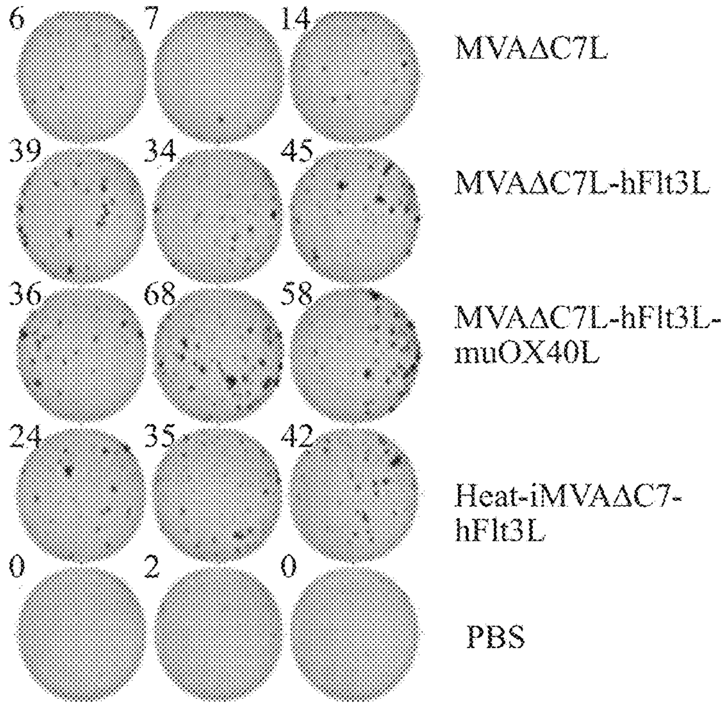
FIGS. 10A and 10B are representative ELISPOT blots and graph showing that IT injection of MVAΔC7L-hFlt3L-TK(−)-muOX40L generated stronger antitumor $CD8^+$ T cell responses in the spleens compared with MVAΔC7L, MVAΔC7L-hFlt3L, or Heat-inactivated MVAΔC7L-hFlt3L. B16-F10-bearing mice were treated with IT injection of either MVAΔC7L-hFlt3L-TK(−)-muOX40L, MVAΔC7L, MVAΔC7L-hFlt3L at $2\times10^7$ pfu, or Heat-inactivated MVAΔC7L-hFlt3L twice, three days apart. Spleens were collected at 2 days after second injection. ELISPOT assay was performed by co-culturing irradiated B16-F10 cells (150,000) and purified $CD8^+$ T cells (300,000) in a 96-well plate.
Figure 10B:
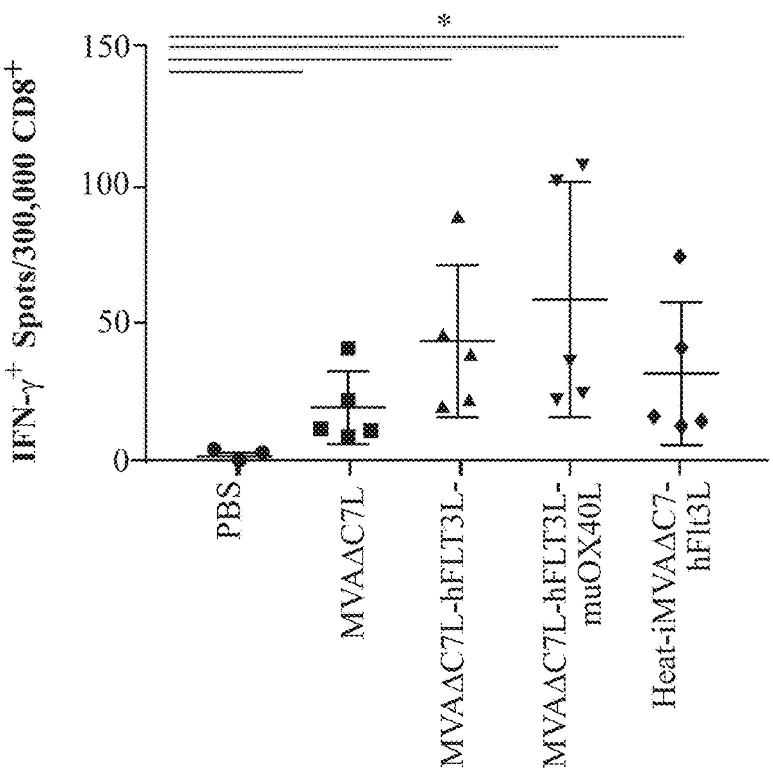

ELISpot was performed to assess the generation of anti-tumor specific $CD8^+$ T cells in the spleens of mice treated with the recombinant viruses as described in Example 5. Briefly, $CD8^+$ T cells were isolated from splenocytes and $3\times10^5$ cells were cultured with $1.5\times10^5$ irradiated B16-F10 cells overnight at 37° C. in anti-IFN-γ-coated BD ELISpot plate microwells. $CD8^+$ T cells were stimulated with B16-F10 cells irradiated with an γ-irradiator and IFN-γ secretion was detected with an anti-IFN-γ antibody. FIG. 10A shows representative images of IFN-$\gamma^-$ spots per 300,000 $CD8^+$ T cells from individual mouse treated with either PBS, MVAΔC7L, MVAΔC7L-hFl3L, MVAΔC7L-hFl3L-TK(−)-mOX40L, or Heat-iMVAΔC7L. FIG. 10B shows the numbers of IFN-$\gamma^+$ spots per 300,000 $CD8^+$ T cells from individual mouse in each group treated with either PBS, MVAΔC7L, MVAΔC7L-hFl3L, MVAΔC7L-hFl3L-TK(−)-mOX40L, or Heat-iMVAΔC7L. These results demonstrate that IT injection of MVAΔC7L-hFlt3L-TK(−)-mOX40LC7LhFl3LmOX40Lis more effective than MVAΔC7L C7Lin generating antitumor $CD8^+$ T cells in treated mice in a murine B16-F10 melanoma bilateral implantation model.

Example 7: IT injection of MVAΔC7L-hFlt3L-TK(−)-mOX40L is effective in eradicating or delaying tumor growth of both injected and non-injected tumors and prolonging survival of mice.

Figure 11A:
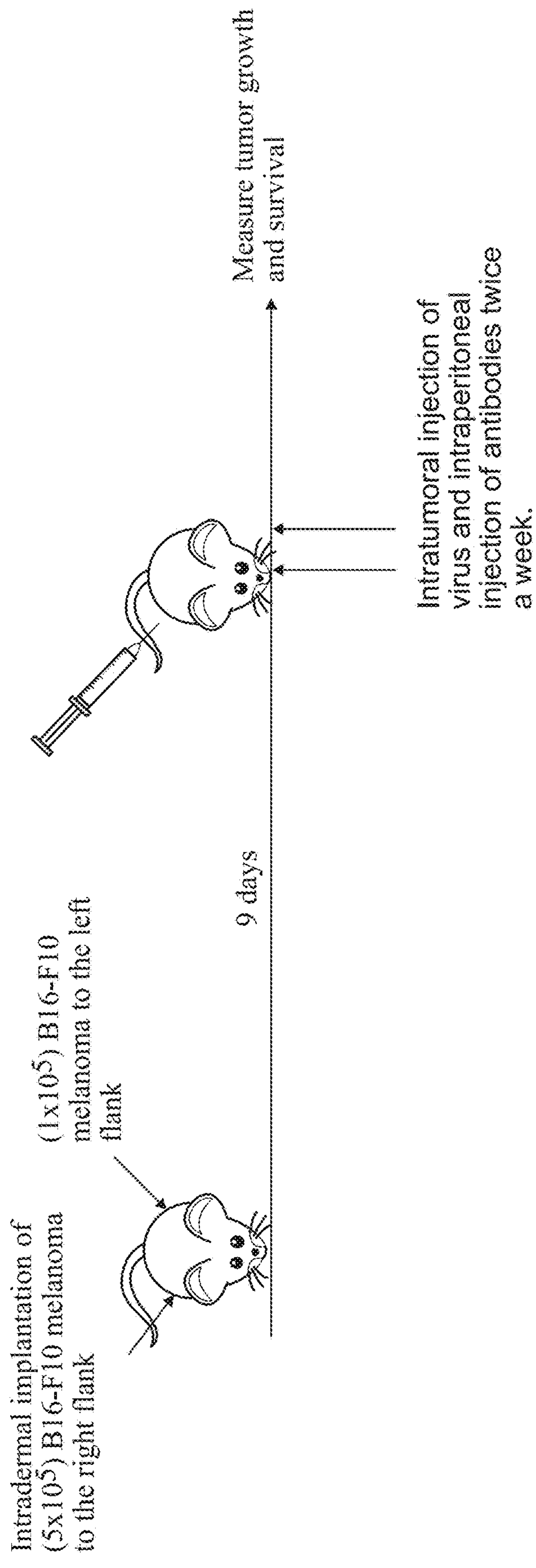
FIGS. 11A-11G are graphical representations of data showing the combination of IT MVAΔC7L-hFlt3L-TK(−)-muOX40L and systemic delivery immune checkpoint blockade antibody anti-CTLA-4 or anti-PD-L1 delays tumor growth and prolongs survival in murine B16-F10 melanoma bilateral tumor implantation model.
Figure 11B:
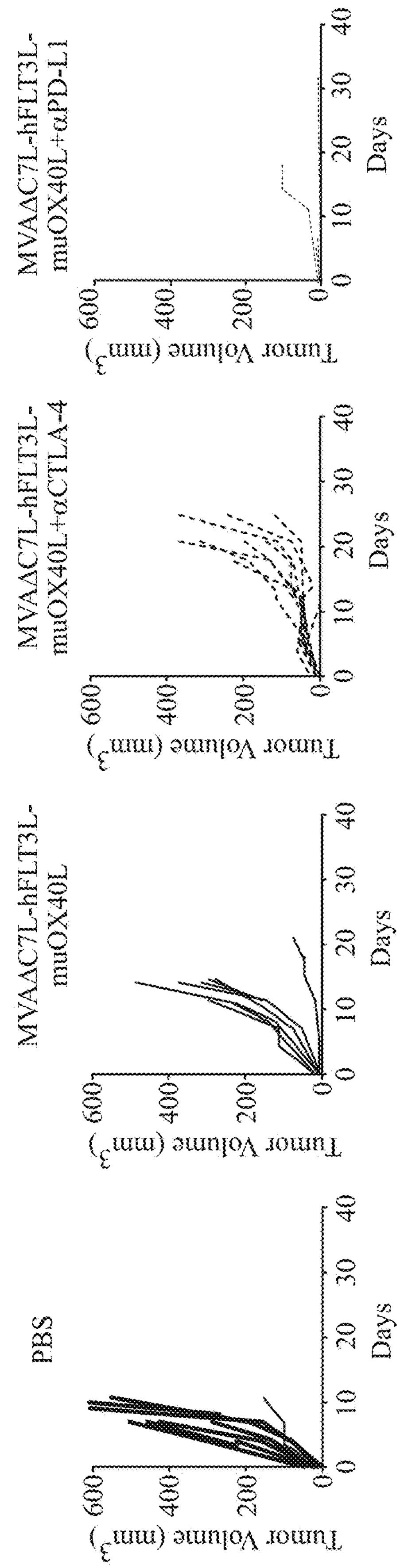
Figure 11C:
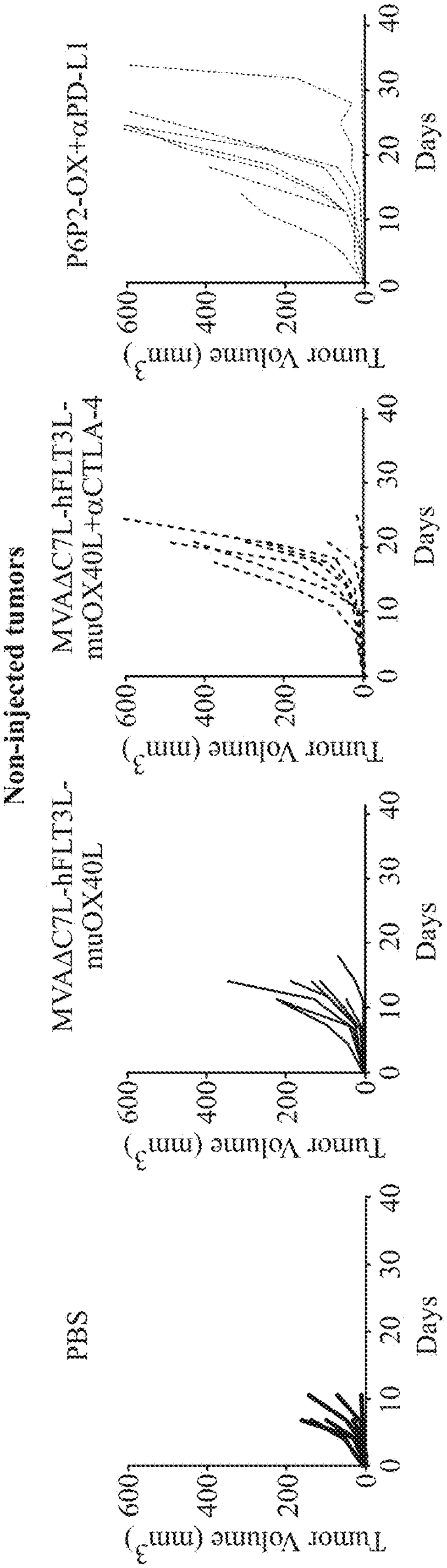
Figure 11D:
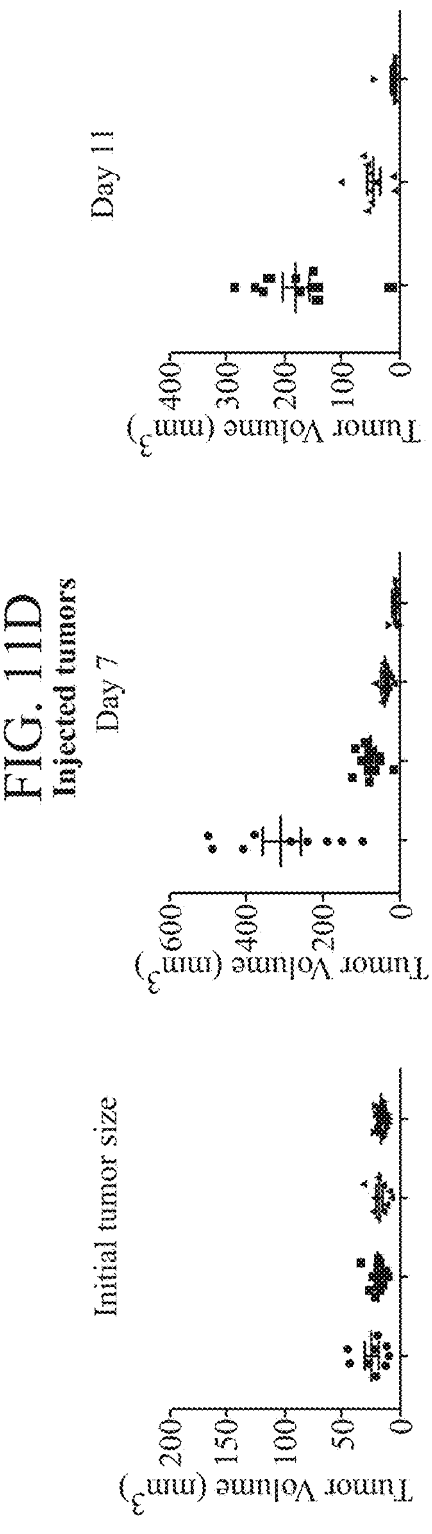
Figure 11E:
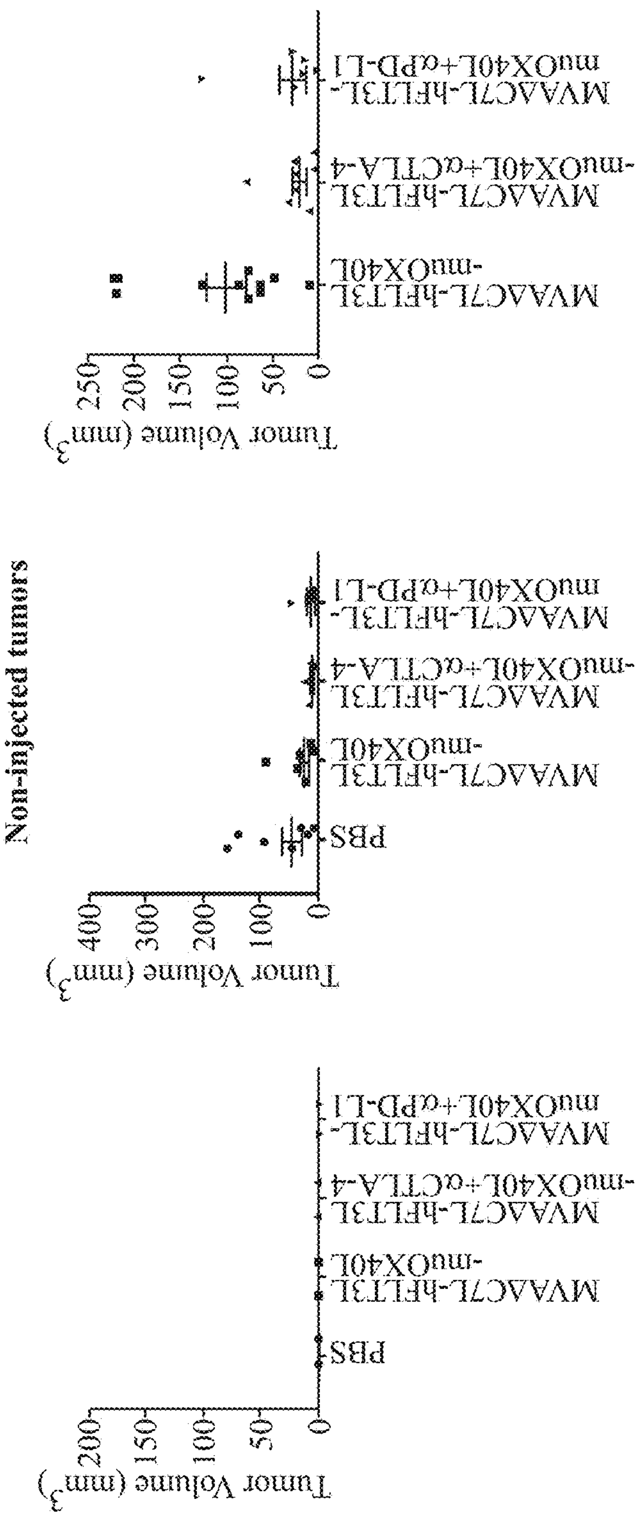
Figures 11F, 11G:
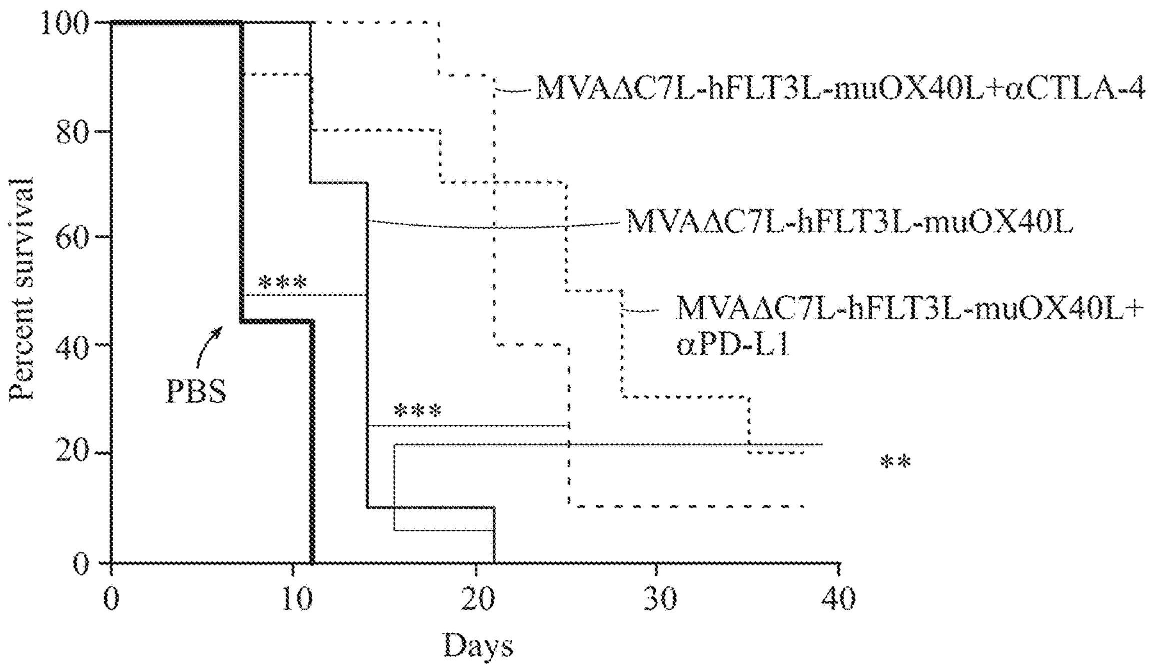
Figure 12:
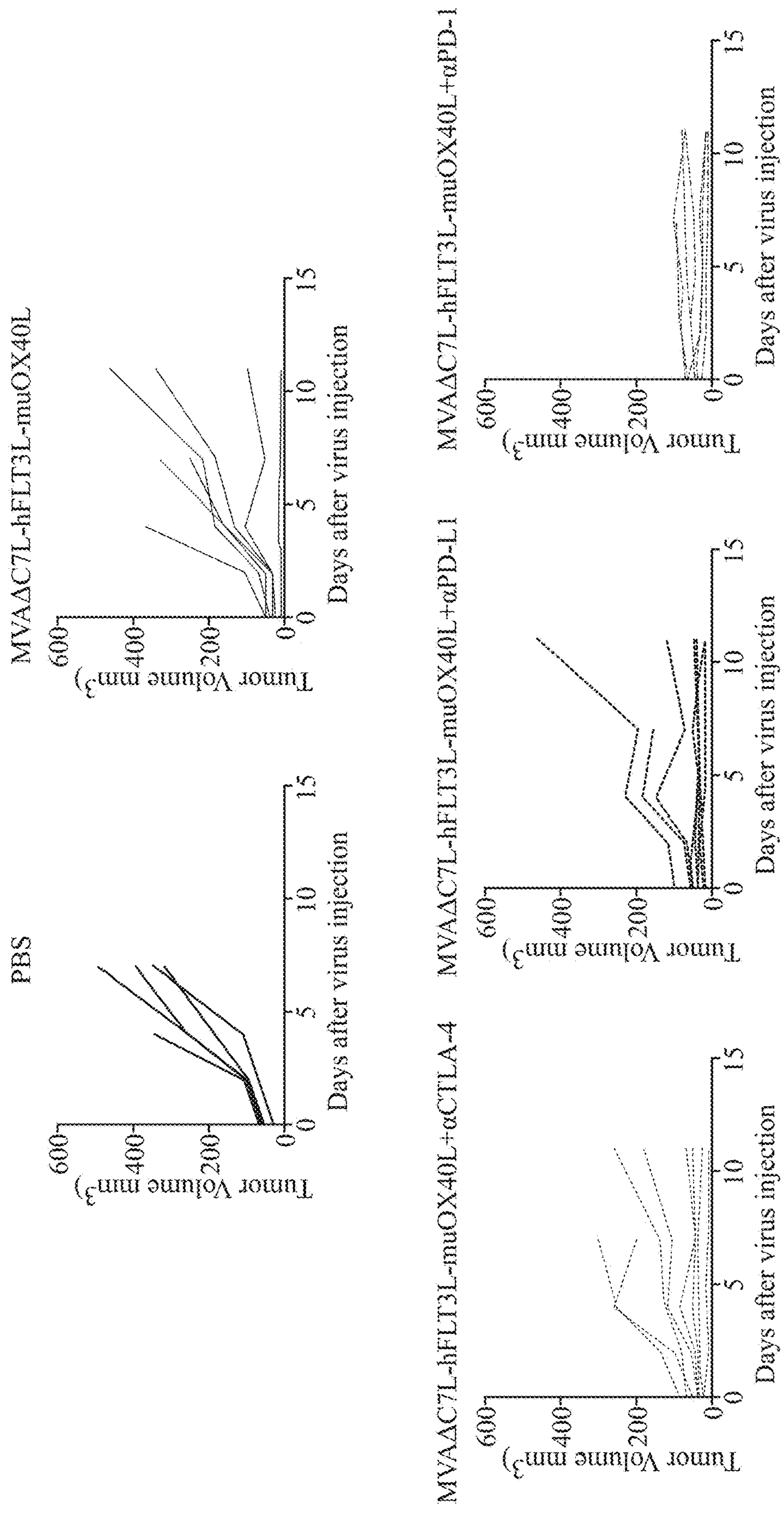
FIG. 12 are a series of graphical representations of data showing tumor growth curves in mice treated in a B16-F10 unilateral large tumor model. Briefly, B16-F10 melanoma cells were implanted intradermally to the right flank of C57B/6J mice ($5\times10^5$ cells). Eleven days post implantation viruses were injected intratumorally twice per week, and Anti-CTLA-4 or anti-PD-L1 antibodies were injected twice per week intraperitoneally.

To test whether IT delivery of MVAΔC7L-hFlt3L-TK(−)-mOX40L generates antitumor effects, a bilateral murine B16-F10 tumor implantation model was used. Briefly, B16-F10 melanoma cells were implanted intradermally to the left and right flanks of C57B/6 mice ($5\times10^5$ to the right flank and $1\times10^5$ to the left flank). Nine days after tumor implantation, MVAΔC7L-hFlt3L-TK(−)-mOX40L ($2\times10^7$ PFU) was delivered into the larger tumors on the right flank twice weekly, with concomitant intraperitoneal (IP) injection of with either anti-CTLA-4 antibody (9D9 clone, 100 μg per mouse), or anti-PD-L1 (250 μg per mouse), or isotype control. Tumor sizes were measured twice a week and mice survival were monitored (FIG. 11A). The volumes of injected and non-injected tumors of individual mouse are shown in FIG. 11B and FIG. 11C. The volumes of injected and non-injected tumors at Day 0, 7, and 11 are shown in FIG. 11D and FIG. 11E. In mice treated with PBS, tumors grew rapidly, which resulted in early death with a median survival of 7 days (FIGS. 11F and 11G). Intratumoral injection of MVAΔC7L-hFlt3L-TK(−)-mOX40LC7LhFl3LmOX40Lresulted in delayed tumor growth and improved survival compared with PBS, with an extension of median survival to 14 days (FIGS. 11F and 11G). B16-F10 melanoma is a very aggressive tumor. The inventors intentionally waited for 9 days after tumor implantation before starting treatment.

Example 8: The combination of IT injection of MVAΔC7L-hFlt3L-TK(−)-mOX40L with systemic delivery of immune checkpoint blockade generates synergistic anti-tumor responses.

The combination with IT delivery of MVAΔC7L-hFlt3L-TK(−)-mOX40L and systemic delivery of anti-CTLA-4 or anti-PD-L1 had superior anti-tumor efficacy compared with IT virus alone. The average tumor volumes of both injected and non-injected tumors were smaller in the IT MVAΔC7L-hFlt3L-TK(−)-mOX40LC7LhFl3LmOX40Lplus anti-PD-L1 group, followed by IT MVAΔC7L-hFlt3L-TK(−)-mOX40LC7LhFl3LmOX40Lplus anti-CTLA-4 group, when compared with IT virus alone or PBS mock treatment (FIGS. 11B-11E). The median survival of mice was extended to 21 days in the IT MVAΔC7L-hFlt3L-TK(−)-mOX40LC7LhFl3LmOX40Lplus anti-CTLA-4 group, and to 26.5 days in the IT MVAΔC7L-hFlt3L-TK(−)-mOX40LC7LhFl3LmOX40Lplus anti-PD-L1 (FIGS. 11F and 11G). This result demonstrates that anti-tumor effects induced by IT MVAΔC7L-hFl3L-TK(−)-mOX40L can be enhanced in the presence of immune checkpoint blockade in a bilateral murine tumor model. In this B16-F10 tumor model, the immune checkpoint blockade antibody alone is not effective, which has been shown by many laboratories including the inventors' laboratories.

Example 9: The combination of IT injection of MVAΔC7L-hFlt3L-TK(−)-mOX40L with systemic delivery of immune checkpoint blockade is more effective than IT virus alone in shrinking and eradicating large established B16-F10 melanoma.

To test whether the combination with IT delivery of MVAΔC7L-hFlt3L-TK(−)-mOX40L and systemic delivery of anti-CTLA-4, anti-PD-1, or anti-PD-L1 had superior anti-tumor efficacy compared with IT virus alone against large established B16-F10 melanoma, $5\times10^5$ cells were intradermally implanted into the right flanks of C57B/6 mice. Nine days after tumor implantation, when the tumors were 5 mm in diameter, they were treated with either IT PBS, MVAΔC7L-hFlt3L-TK(−)-mOX40L alone, MVAΔC7L-hFlt3L-TK(−)-mOX40L plus IP anti-CTLA-4, MVAΔC7L-hFlt3L-TK(−)-mOX40L plus IP anti-PD-1, or MVAΔC7L-hFlt3L-TK(−)-mOX40L plus IP anti-PD-L1 twice weekly. Tumor volumes were measured and mice survival was monitored. Although IT MVAΔC7L-hFlt3L-TK(−)-mOX40L alone has some anti-tumor effects, the combination of IT virus with anti-PD-1 had the best synergistic effects, followed by the combinations of IT virus plus anti-PD-L1, and IT virus plus anti-CTLA-4.

Example 10: Generation of recombinant MVAΔC7L-hFlt3 with a TK-deletion expressing human OX40L.

Figure 13A:
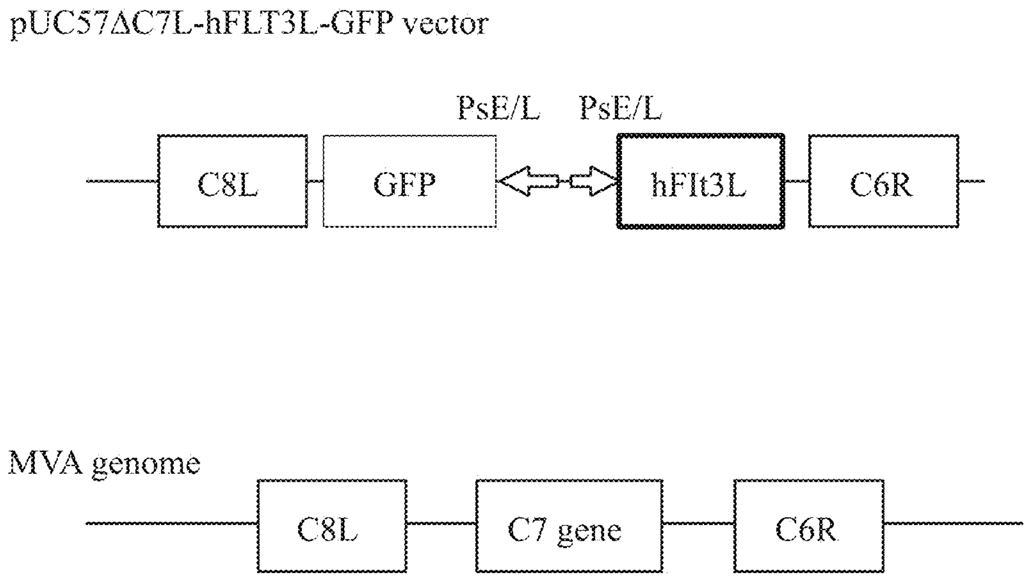
FIGS. 13A and 13B are schematic diagrams of two-step homologous recombination to generate MVAΔC7L-hFlt3L-TK(−)-huOX40L.
Figure 13B:
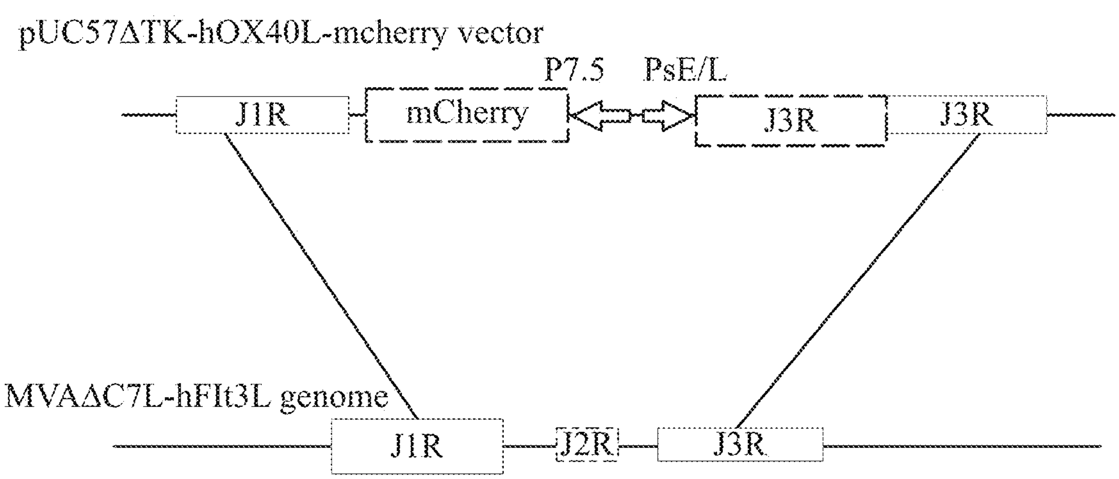
Figure 13C:
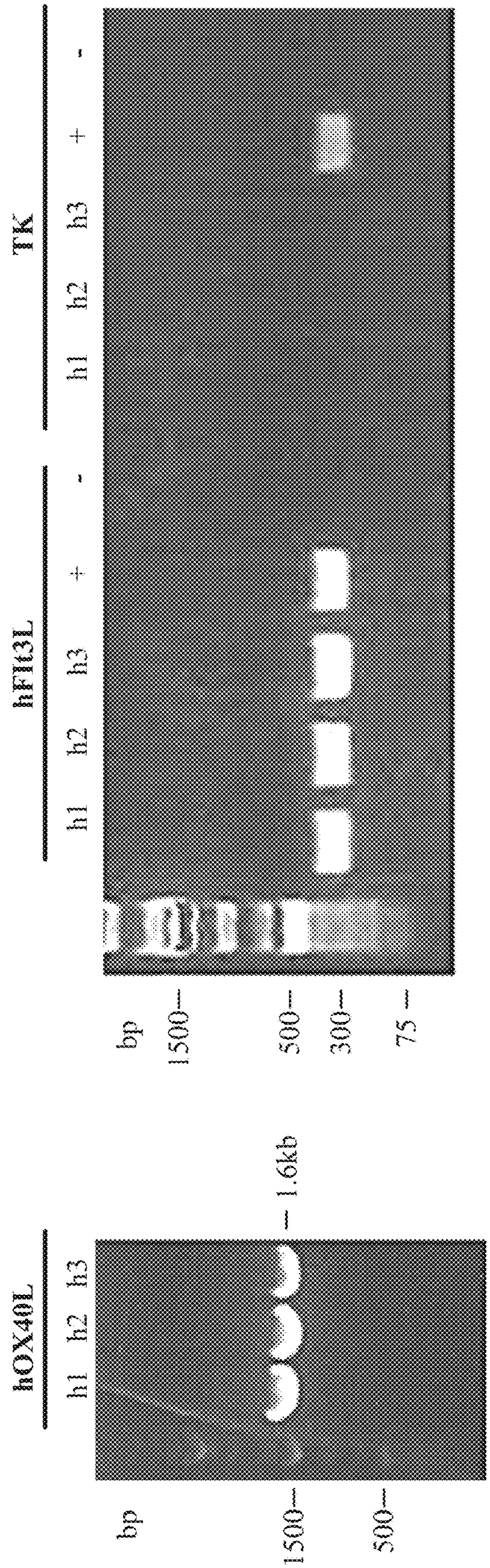
FIG. 13C: PCR verification of three independent clones of recombinant MVAΔC7L-hFlt3L-TK(−)-huOX40L, which contains hOX40L gene and hFlt3L gene insert but lacks TK (J2R) gene. H1, h2 and H3 are individual recombinant MVA. "+": positive control for the PCR reaction.

This example describes the generation of a recombinant vaccinia MVAΔC7L-hFlt3L virus comprising a TK-deletion expressing human OX40L (hOX40L). FIG. 13A shows the first step to generate MVAΔC7L-hFl3L, which has been described in Example 4. FIG. 13B shows the second step to generate MVAΔC7L-hFl3L-TK(−)-hOX40L. A plasmid containing human OX40L gene under the control of the vaccinia PsE/L as well as the mCherry under the control of vaccinia P7.5 promoter flanked by the thymidine kinase (TK) gene on either side was constructed. BHK21 cells were infected with MVAΔC7L-hFl3L at a multiplicity of infection (MOI) of 0.5 for 1 h, and then were transfected with the plasmid DNAs described above. The infected cells were collected at 48 h. Recombinant viruses were selected through picking mCherry foci, and plaque purified. PCR analysis was performed to verify that MVAΔC7L-hFl3L-TK (−)-hOX40L lacks C7L C7Lgene and part of the TK gene, but with both hFl3L and hOX40L insertion (data not shown). The insert was also sequenced to verify the accuracy of the sequences.

Example 11: The recombinant viruses MVAΔC7L-hFlt3L-TK(−)-mOX40L and MVAΔC7L-hFlt3L-TK(−)-hOX40L replicate efficiently in chicken embryo fibroblasts.

Figure 14A:
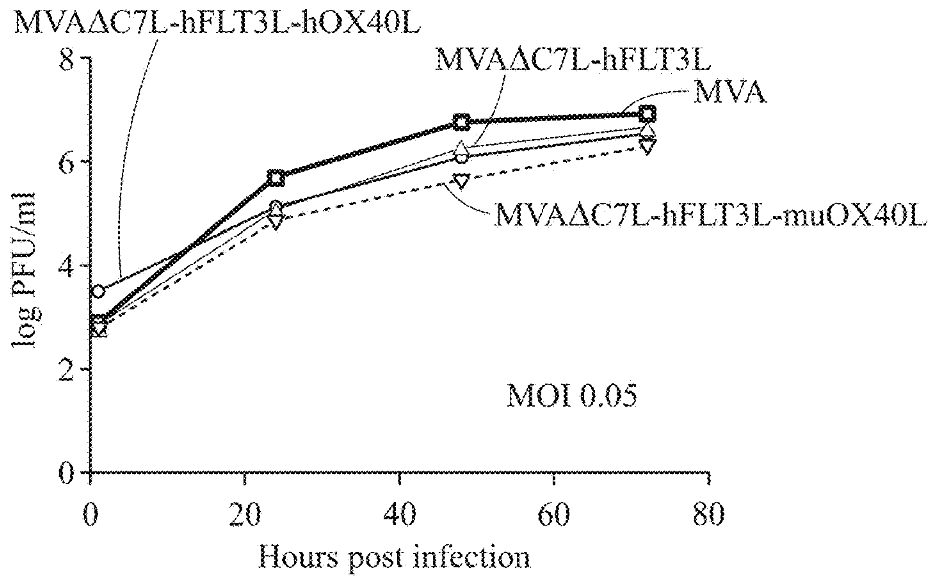
FIGS. 14A and 14B are two graphs showing a multi-step growth of the parental MVA and recombinant viruses, including MVAΔC7L-hFlt3L, MVAΔC7L-hFlt3L-TK(−)-muOX40L, MVAΔC7L-hFlt3L-TK(−)-hOX40L in primary chicken embryo fibroblasts (CEFs).
Figure 14B:
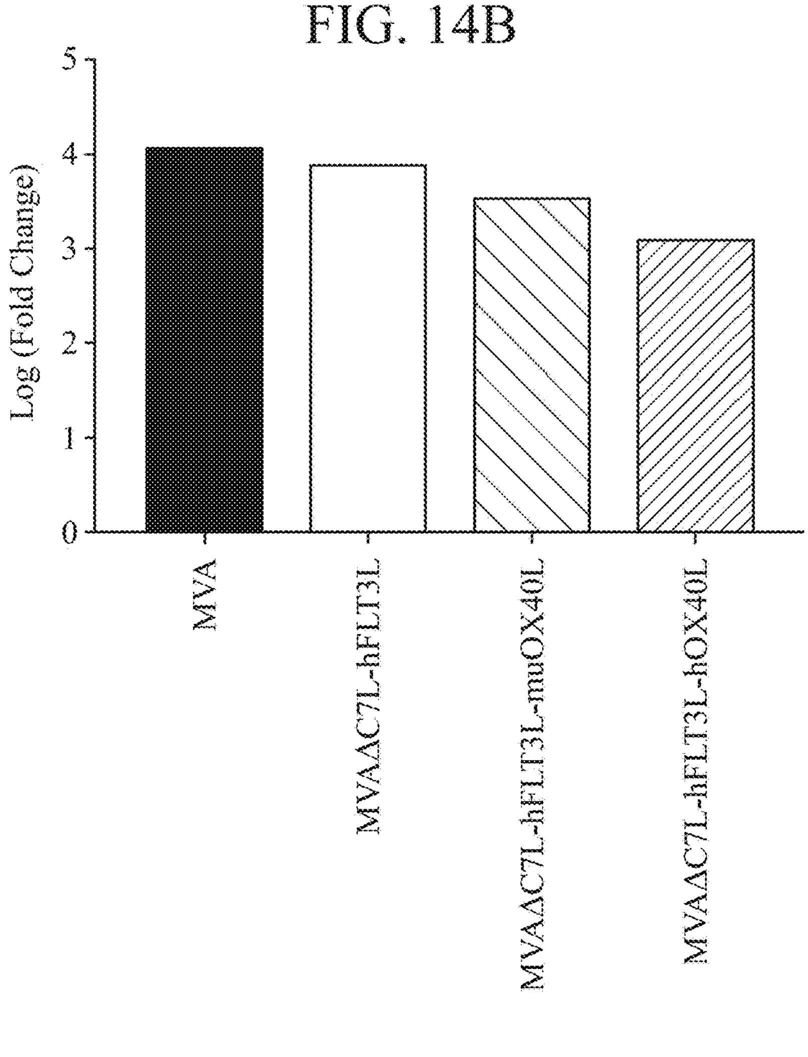

MVA is commonly manufactured in chicken embryo fibroblasts (CEFs). To test whether the recombinant MVA viruses, MVAΔC7L-hFlt3L-TK(−)-mOX40L and MVAΔC7L-hFlt3L-TK(−)-hOX40L replicate in CEFs, a multi-step replication assay was performed. $5\times10^5$ CEF cells were seeded in a 6-well plate and were cultured overnight. Cells were infected with either MVA, MVAΔC7L-hFlt3L, MVAΔC7L-hFlt3L-TK(−)-mOX40L, or MVAΔC7L-hFlt3L-TK(−)-hOX40L at a MOI of 0.05 for one hour. The inoculum was removed and cells were washed with PBS once and incubated with fresh medium. Cells were collected at 1, 24, 48, and 72 h post infection. Viral titers were determined on BHK21 cells. FIG. 14A shows viral titers of MVA, MVAΔC7L-hFl3L, MVAΔC7L-hFl3L-TK(−)-mOX40L, or MVAΔC7L-hFl3L-TK(−)-hOX40L over time after infection in CEFs. All of the viruses replicate efficiently in CEFs, with increase of titers over 1,000 to 10,000-fold (FIG. 14B). The recombinant MVA viruses have slight reduction of viral titers compared with the parental MVA (FIG. 14A and 14B).

Example 12: The recombinant viruses MVAΔC7L-hFlt3L-TK(−)-hOX40L express hOX40L protein on the surface of infected cells.

Figure 15A:
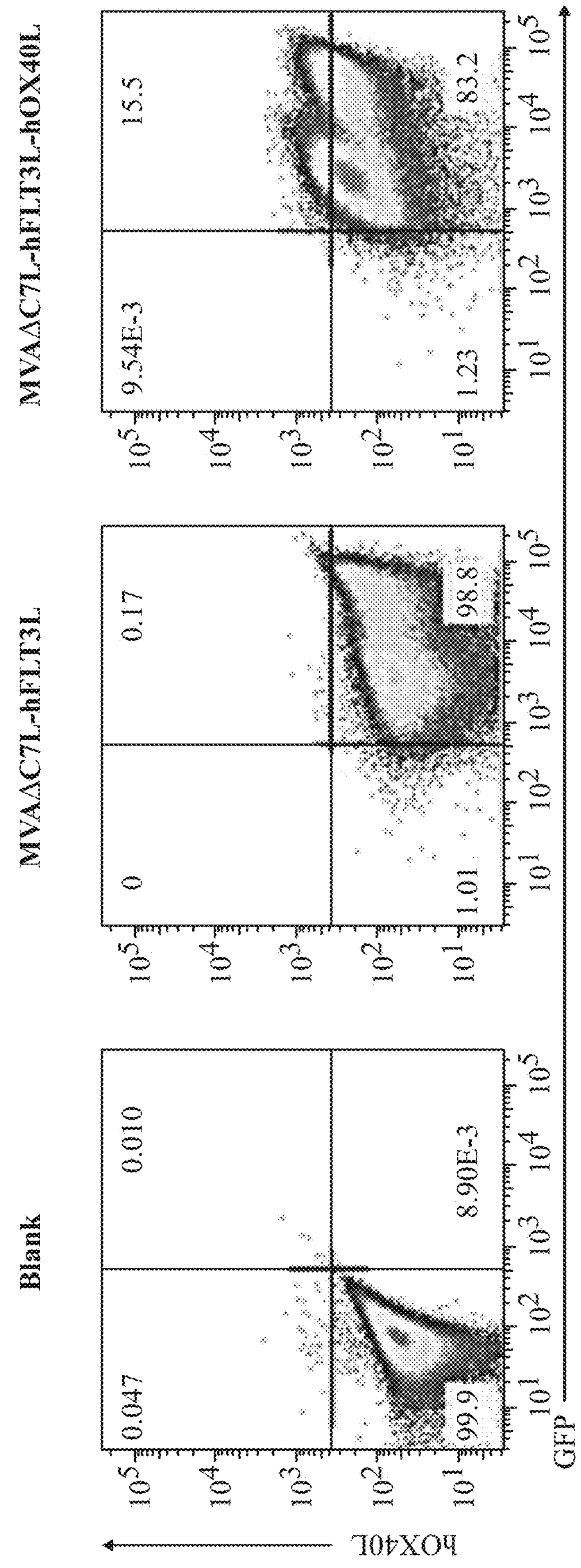
FIGS. 15A and 15B are a series of representative dot plots of FACS data showing the expression of hOX40L in BHK21 cells and human monocyte-derived dendritic cells (mo-DCs) infected by MVAΔC7L-hFlt3L-TK(−)-hOX40L virus.

FACS analysis was used to determine the expression of hOX40L on the surface of infected cells. Briefly, BHK21 cells were infected either with MVAΔC7L-hFlt3L or MVAΔC7L-TK(−)-hOX40L at a MOI of 10. At 24 h post infection, cells were stained with PE-conjugated anti-hOX40L antibody. The expression of hOX40L on the surface of infected cells was evaluated by FACS analysis. FIG. 15A shows that the expression levels of GFP and hOX40L in infected BHK21 cells.

Figure 15B:
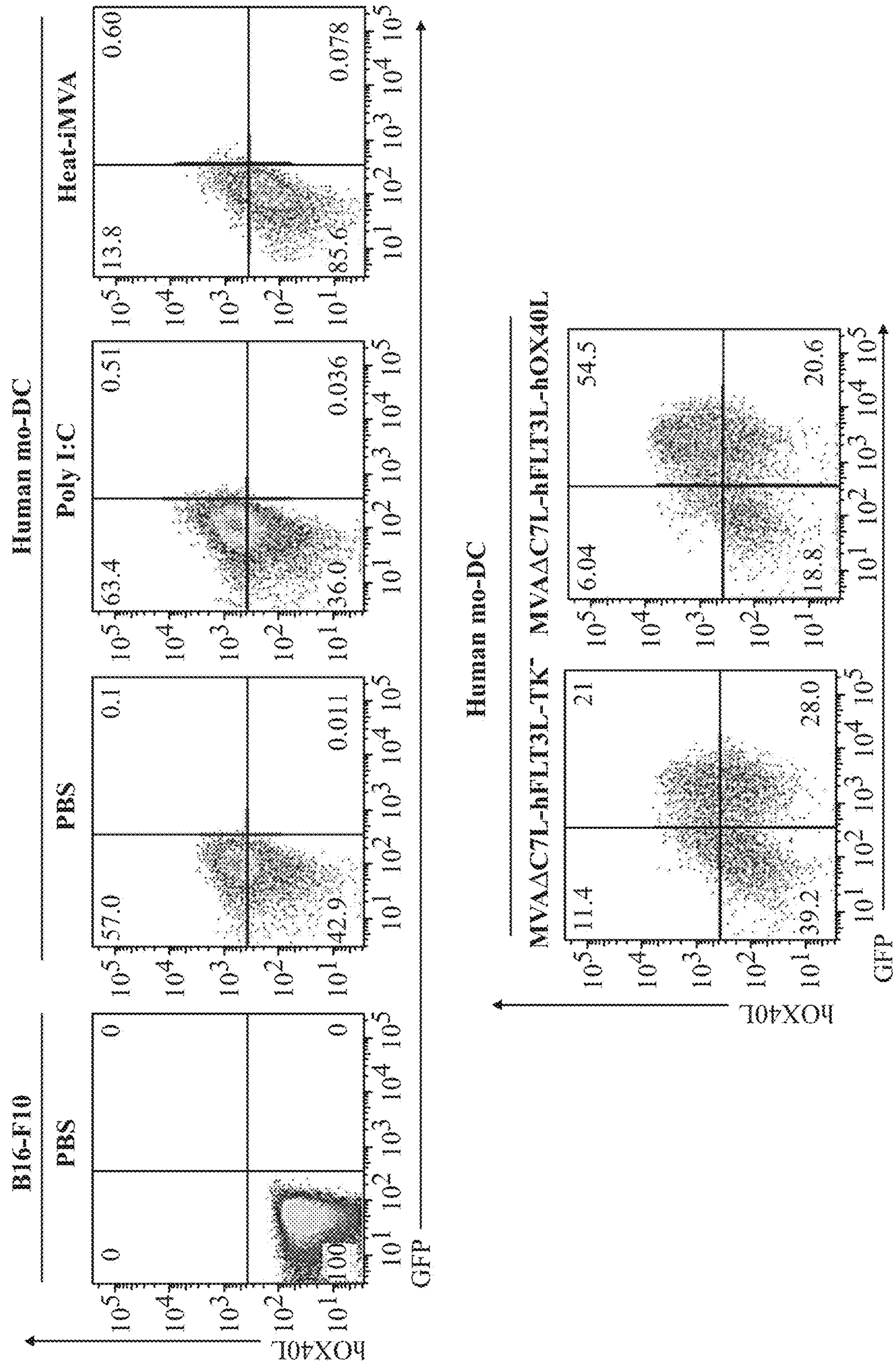

To test whether MVAΔC7L-hFl3L-TK(−)-hOX40L can infect human monocyte-derived DCs (mo-DCs), adherent human peripheral blood mononuclear cells (PBMCs) were cultured in the presence of human GM-CSF and IL-4 for 5 days. On Day 6, cells were either treated with poly I:C at 10 μg/ml, or infected with Heat-iMVA, MVAΔC7L-TK(−), or MVAΔC7L-hFl3L-TK(−)-hOX40L at MOI of 1. At 24 h post infection, cells were collected and stained with PE-conjugated anti-hOX40L antibody prior to FACS analyses. Compared with murine B16-F10 cells, human mo-DCs express hOX40L at the baseline. Poly I:C treatment leads to modest increase of hOX40L expression on the cell surface. Infection with Heat-iMVA reduces the expression of hOX40L. Both MVAΔC7L-hFl3L and MVAΔC7L-TK(−)-hOX40L infection of mo-DCs resulted in $GFP^+$ cells, around 50% and 75%, respectively. Only MVAΔC7L-TK(−)-hOX40L infection led to the increased expression of hOX40L on infected mo-DCS (FIG. 15B). These results indicate that MVAΔC7L-TK(−)-hOX40L can effectively infect human mo-DCs and express hOX40L on the surface of infected cells. This can be potentially important for interacting with T cells through OX40L-OX40 interaction, as well as promoting the survival and proliferation of antigen-specific and activated $CD8^+$ and $CD4^+$ T cells.

Example 13: The recombinant viruses MVAΔC7L-hFlt3L-TK(−)-hOX40L express hOX40L mRNA at high levels in infected cells.

Figure 16A:
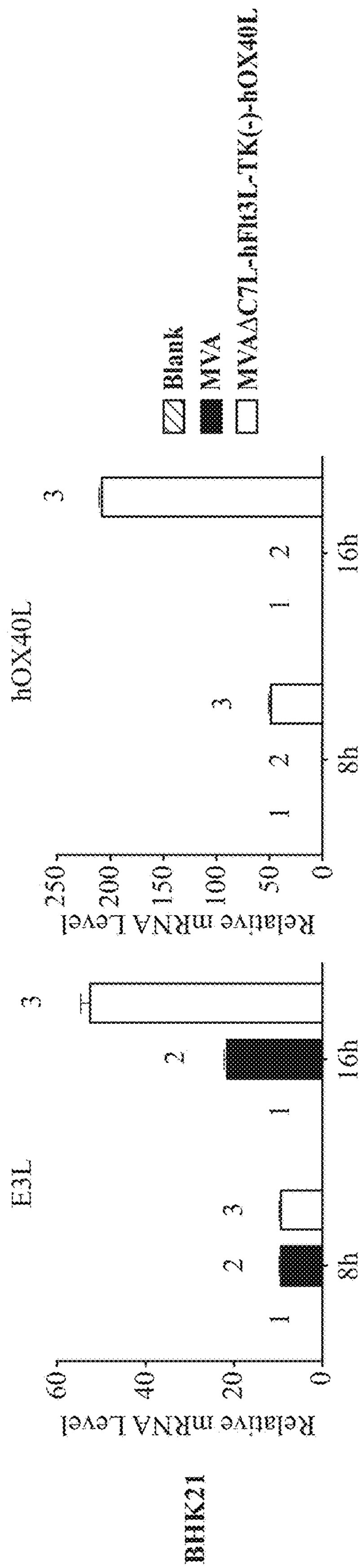
FIGS. 16A and 16B are a series of graphical representations of data showing hOX40L mRNA levels in MVAΔC7L-hFlt3L-TK(−)-hOX40L-infected BHK21 (FIG. 16A) and B16-F10 cells (FIG. 16B). BHK21 or B16-F10 cells were infected with either MVA or MVAΔC7L-hFlt3L-TK(−)-hOX40L at a MOI of 10. At 8 and 16 h post infection, cells were collected and RNAs were extracted. Quantitative RT-PCR analyses were performed to examine the expression of viral E3L gene and hOX40L gene.
Figure 16B:
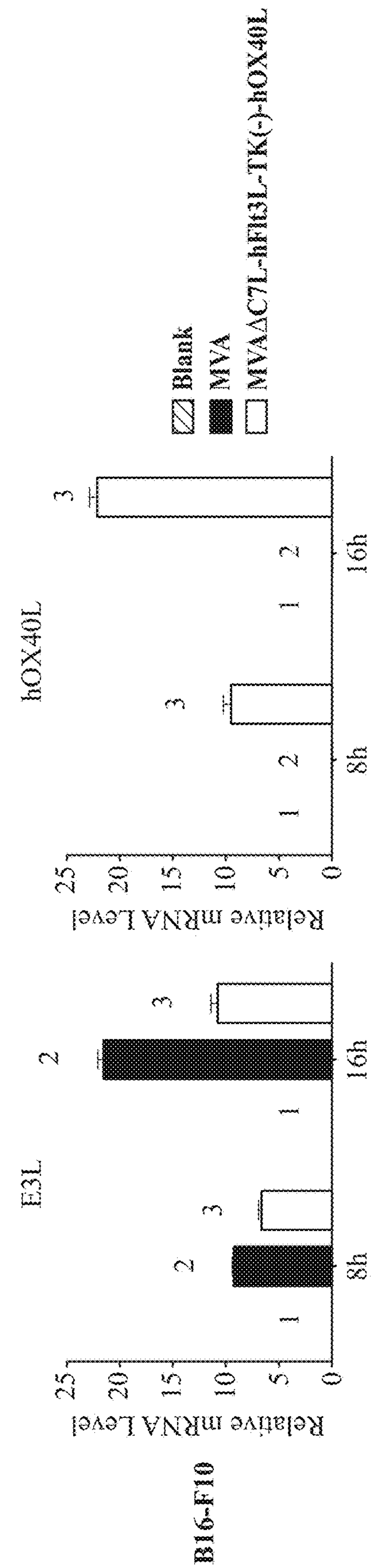

Quantitative RT-PCR analysis was used to assess the hOX40L mRNA expression level in infected BHK21 and B16-F10 melanoma cells. Briefly, BHK21 and B16-F10 melanoma cells were infected with either MVA or MVAΔC7L-hFlt3L or MVAΔC7L-TK(−)-hOX40L for 8 or 16 h. RNAs were extracted from the cells and quantitative RT-PCR analysis was performed to assess the expression of hOX40L mRNA. Vaccinia E3L mRNA levels were also assessed. Infection of BHK21 and B16-F10 melanoma cells results in the expression of both E3L and hOX40L at 8 and 16 h post infection. The mRNA levels of both E3L and hOX40L at 16 h were higher than those at 8 h post infection (FIGS. 16A and 16B). Overall, the expression of hOX40L was higher in MVAΔC7L-TK(−)-hOX40L-infected BHK21 cells compared with that in B16-F10 cells, which is consistent with the replication efficiency of this virus in BHK21 (permissive) and B16-F10 cells (non-permissive).

Example 14: Cloning of vaccinia viral early genes into expression vectors.

Figure 17:
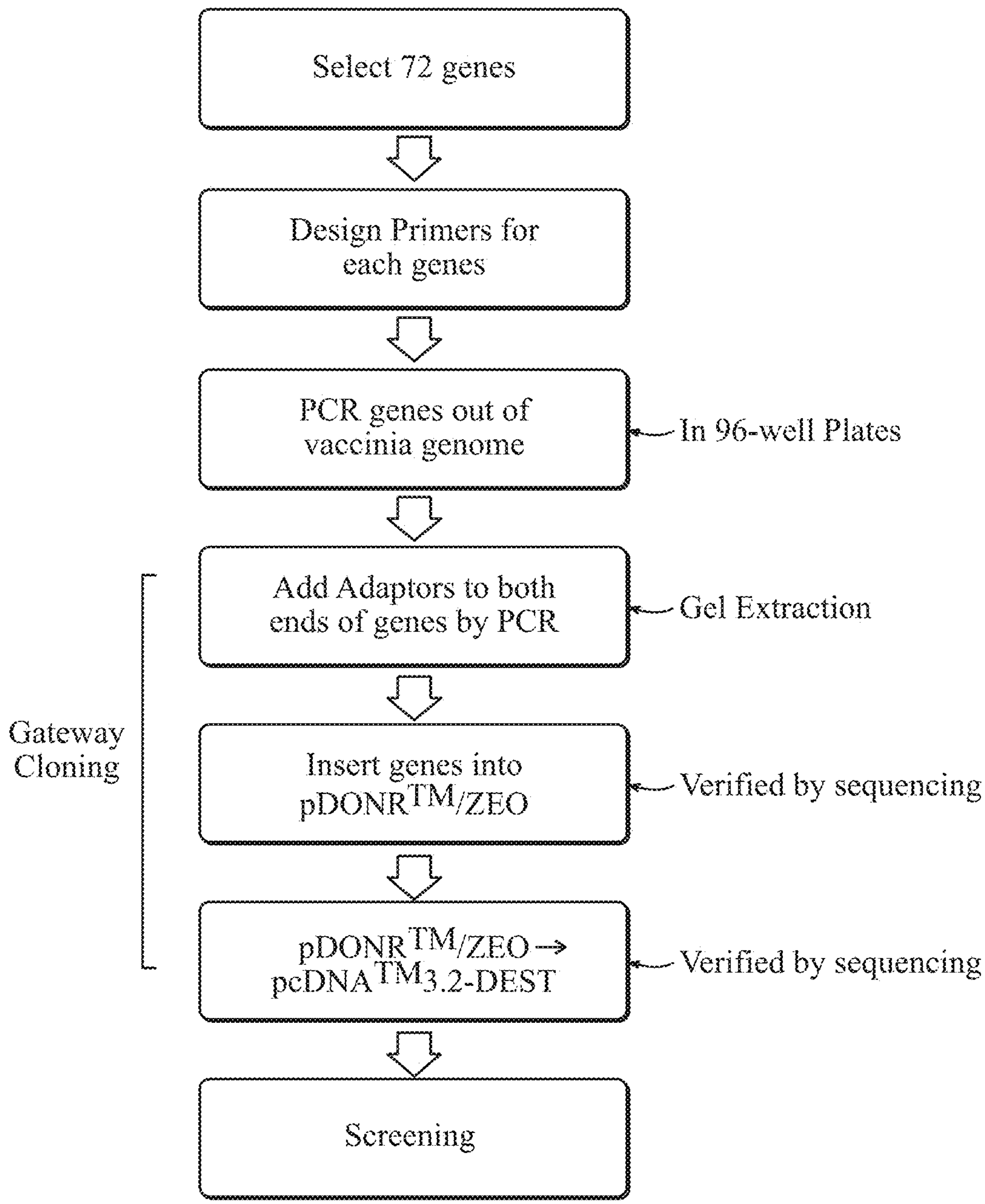
FIG. 17 is a schematic diagram showing the workflow of constructing vaccinia virus viral early gene expression plasmids. 72 viral early genes were selected. PCR was performed to amplify the gene of interest from vaccinia viral genome. Adaptors were added to both ends of PCR products by a second round of PCR. Then the DNA fragments were cloned into pDONR™/ZEO, and then to pcDNA™3.2-DEST, a mammalian expression vector. The DNA constructs were later verified by sequencing. The plasmid DNAs were then used to transfect into HEK-293T cells, along with other plasmids, which will be described below.

Vaccinia viral early genes were screened for their abilities to inhibit the cGAS/STING cytosolic DNA-sensing pathway. To do that, 72 vaccinia viral early genes were selected and their open reading frames were PCR-amplified and cloned into expression vector (pcDNA3.2-DEST) using Gateway Cloning technology (FIG. 17).

Example 15: Screening strategy for identifying viral inhibitors of the cGAS/STING pathway.

Figure 18:
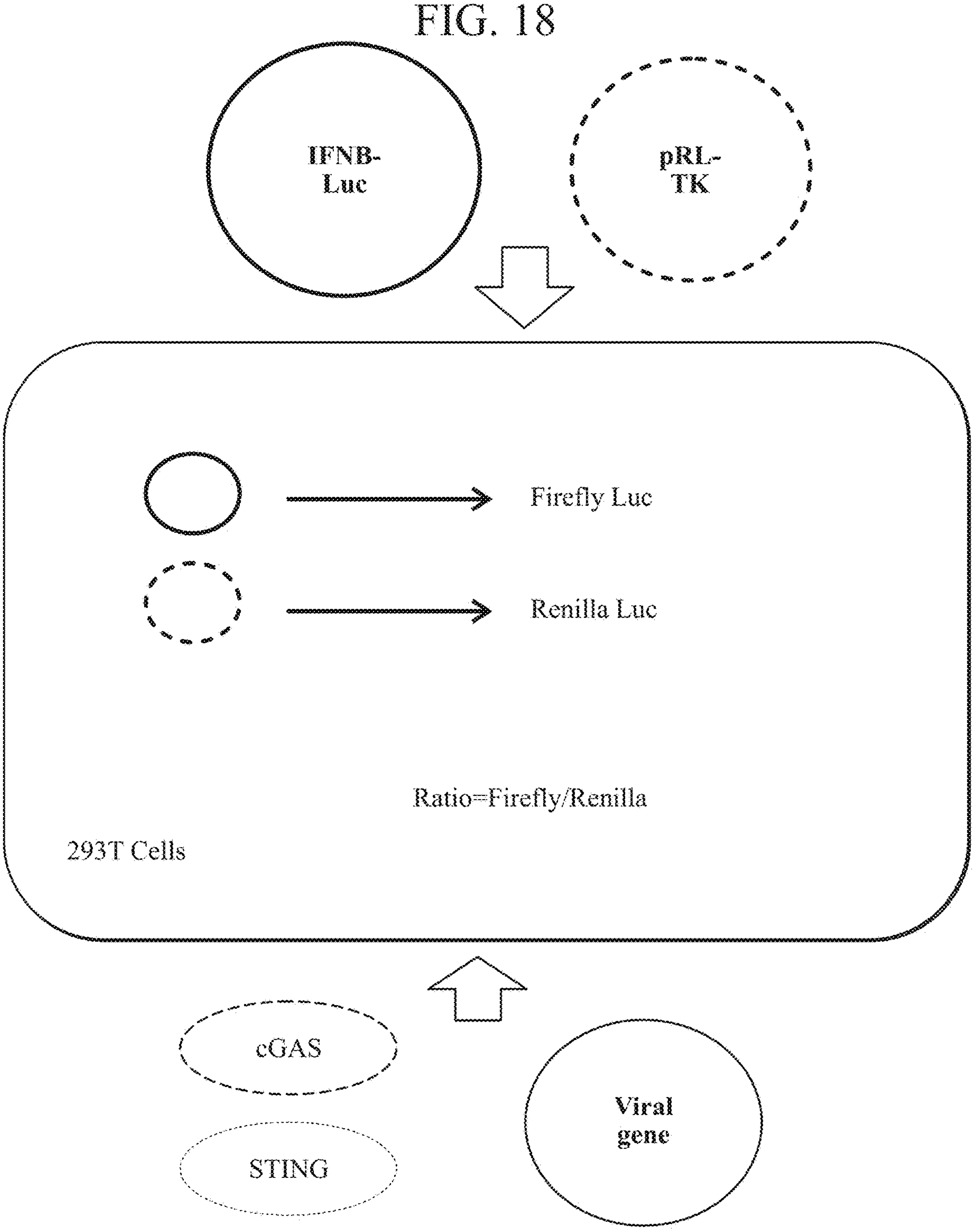
FIG. 18 shows dual luciferase screening strategy. In HEK293T cells, cGAS and STING expression plasmids were co-transfected with IFN-β luciferase plasmid and pRL-TK. Viral gene expression plasmids or vector were transfected together. After 24 h, luciferase signal was measured. The relative luciferase activity was expressed as arbitrary units by normalizing firefly luciferase activity to Renilla luciferase activity.

A dual-luciferase assay system was used to screen for potential vaccinia viral inhibitors of the cGAS/STING pathway in HEK293T-cells, a human embryonic kidney cell line transformed with SV40 large T antigen (FIG. 18). HEK293T-cells were transfected with plasmids expressing IFNB-firefly luciferase reporter, a control plasmid pRL-TK that expresses Renilla luciferase, murine cGAS, human STING, and individual vaccinia viral early gene as indicated. Murine cGAS (50 ng) and hSTING (10 ng) were used at suboptimal dosages for the purpose of identifying inhibitors. The transfected plasmids containing viral genes were used at 200 ng. IFNB-firefly luciferase reporter and control plasmid pRL-TK were used at 50 ng and 10 ng, respectively. Dual luciferase assays were performed at 24 h post transfection. The relative luciferase activity was expressed as arbitrary units by normalizing firefly luciferase activity to Renilla luciferase activity. Adenovirus E1A has been shown to inhibit this pathway through interacting with STING (Lau et al., *Science* (2015)) and was used as a positive control for this screening assay.

Example 16: Identification of 8 vaccinia viral early genes that have potential to inhibit the cGAS/STING pathway.

Figure 19A:
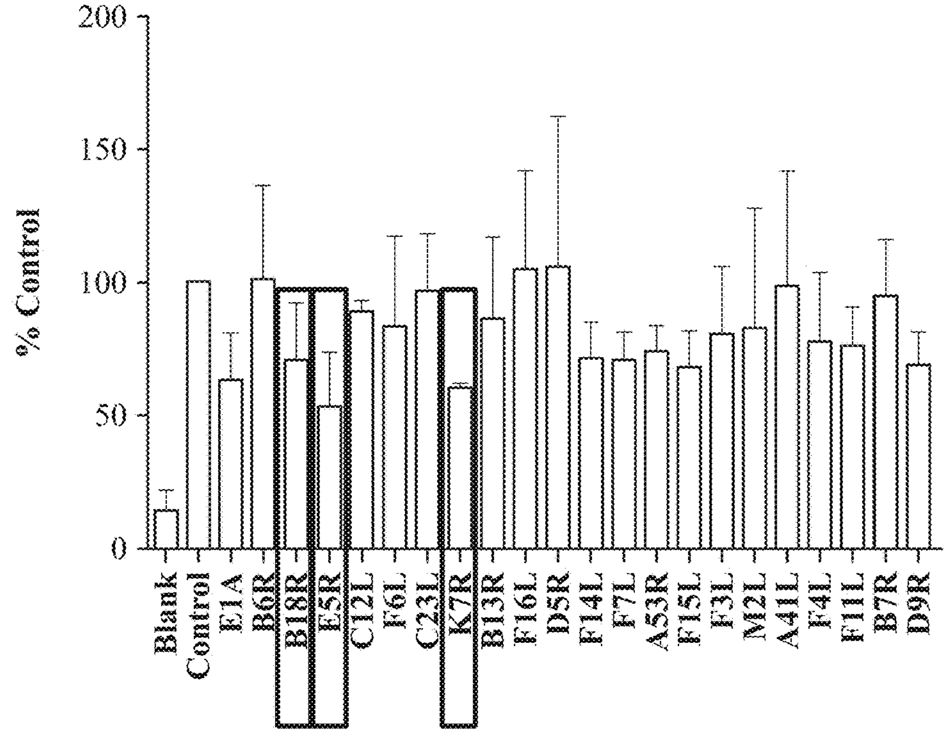
FIGS. 19A-19C show the dual luciferase screening results of vaccinia virus ORFs that inhibit cGAS/STING-dependent IFNβ-luc activity.
Figure 19B:
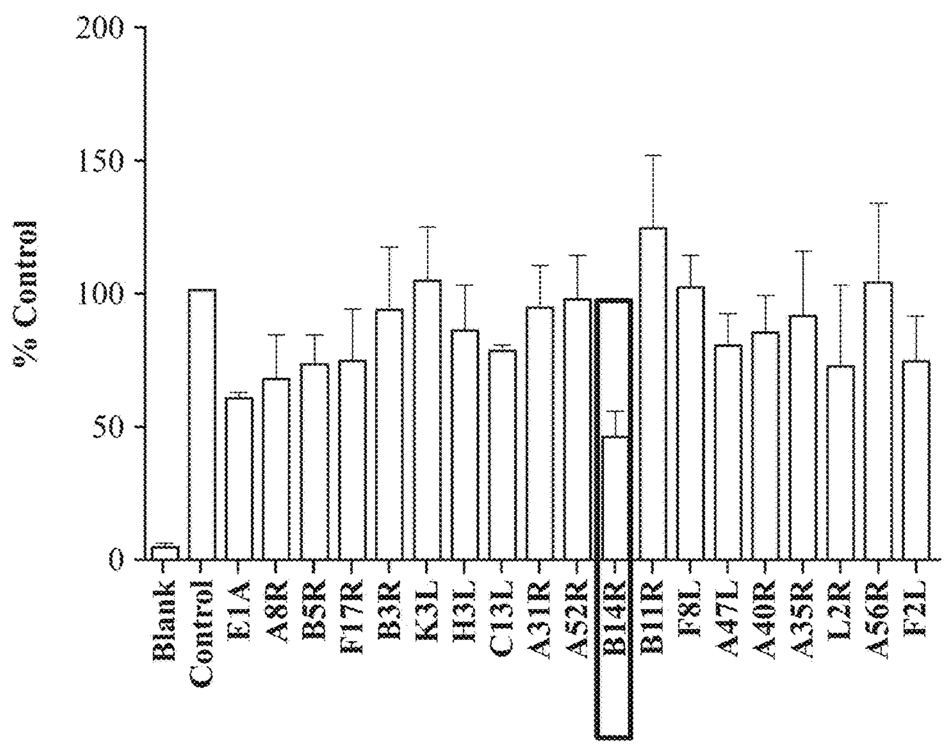
Figure 19C:
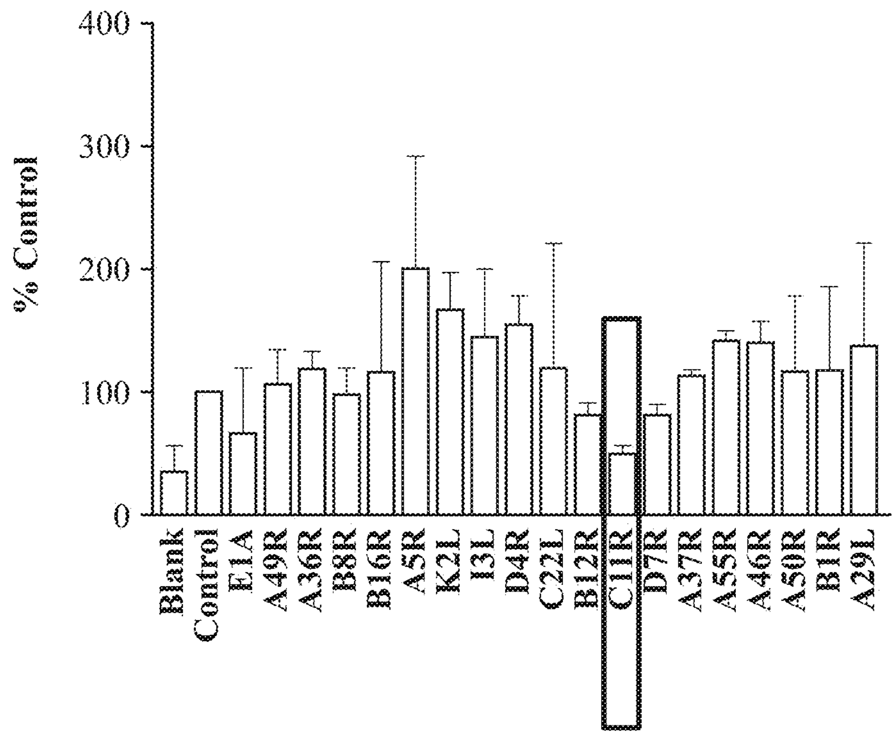

A dual-luciferase assay system described above was used to screen for vaccinia viral inhibitors of the cGAS/STING pathway. A total of eight vaccinia viral early genes (B18R (WR200), E5R, K7R, B14R, C11R, M1L, N2L, and WR199) were identified as potential inhibitors of this pathway. Data relating to five of these vaccinia viral early genes (B18R (WR200), E5R, K7R, B14R, and C11R) are shown in FIGS. 19A-19C. Those include some viral genes that have known inhibitory function of the type I IFN system, including B18R (WR200), which encodes a type I IFN binding protein (Alcami et al., (1995)). The roles of E5R, K7R, B14R, and C11R in the type I IFN pathway have not been elucidated previously, although K7R, B14R and C1IR have been described as vaccinia virulence factors (Benfield et al., *J. Gen. Virol.* (2013), Chen et al., (2008); McCoy et al., (2010); Martin et al., (2012)). E5R has been reported to be a viral early protein associated with virosome (Murcia-Nicolas et al., (1999)). Its role in immune evasion has never been reported.

Example 17: Confirmation that overexpression of B18R, E5R, K7R, C11R, or B14R down-regulates IFNB gene expression induced by the co-transfection of cGAS and hSTING in HEK293-T cells.

Figure 20A:
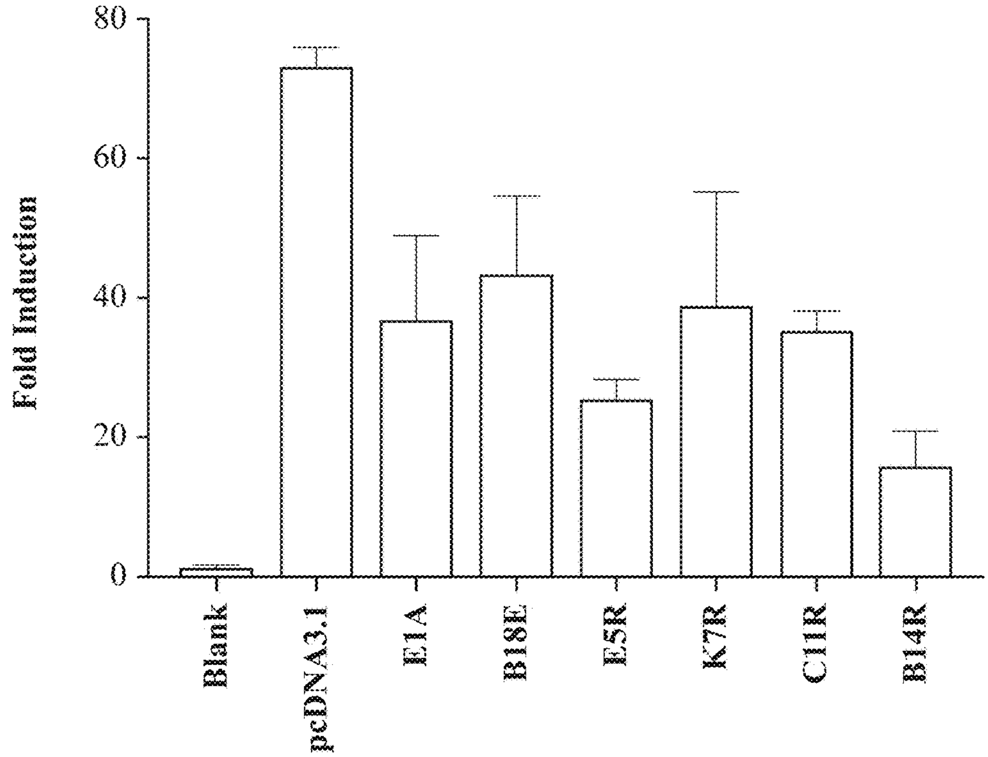
FIGS. 20A-20E. Vaccinia virus B18, E5, K7, C11 and B14 inhibits cGAS/STING-induced IFNβ promoter activity. HEK293T cells were transfected with IFNB luciferase reporter, cGAS, STING and expression plasmids as indicated, and luciferase activity was assayed 24 h after transfection.
Figure 20B:
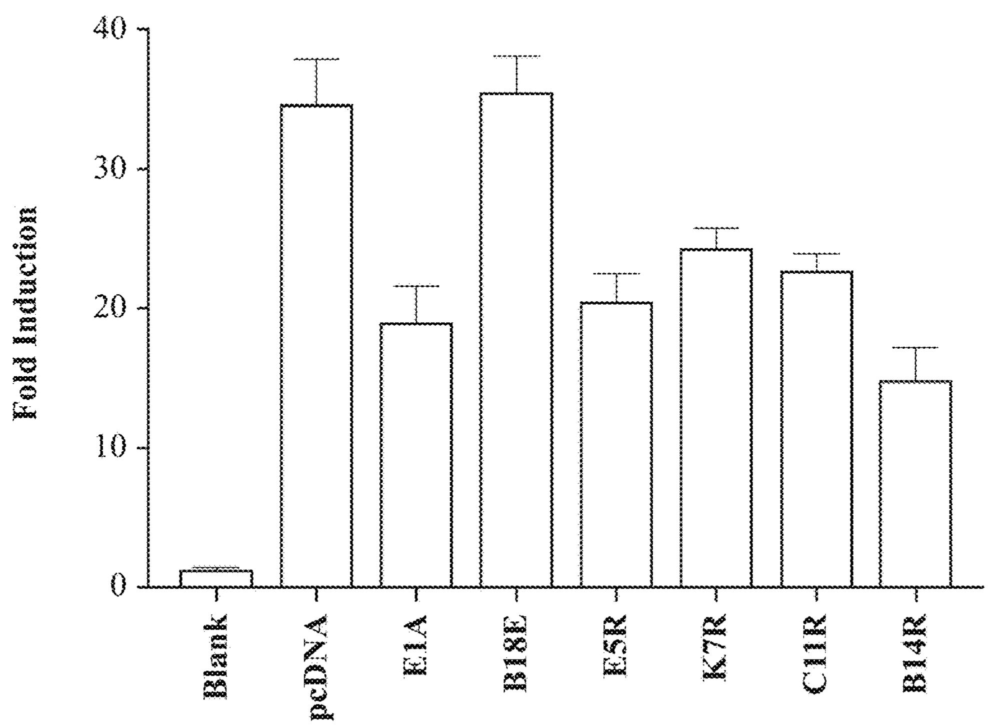
Figure 20C:
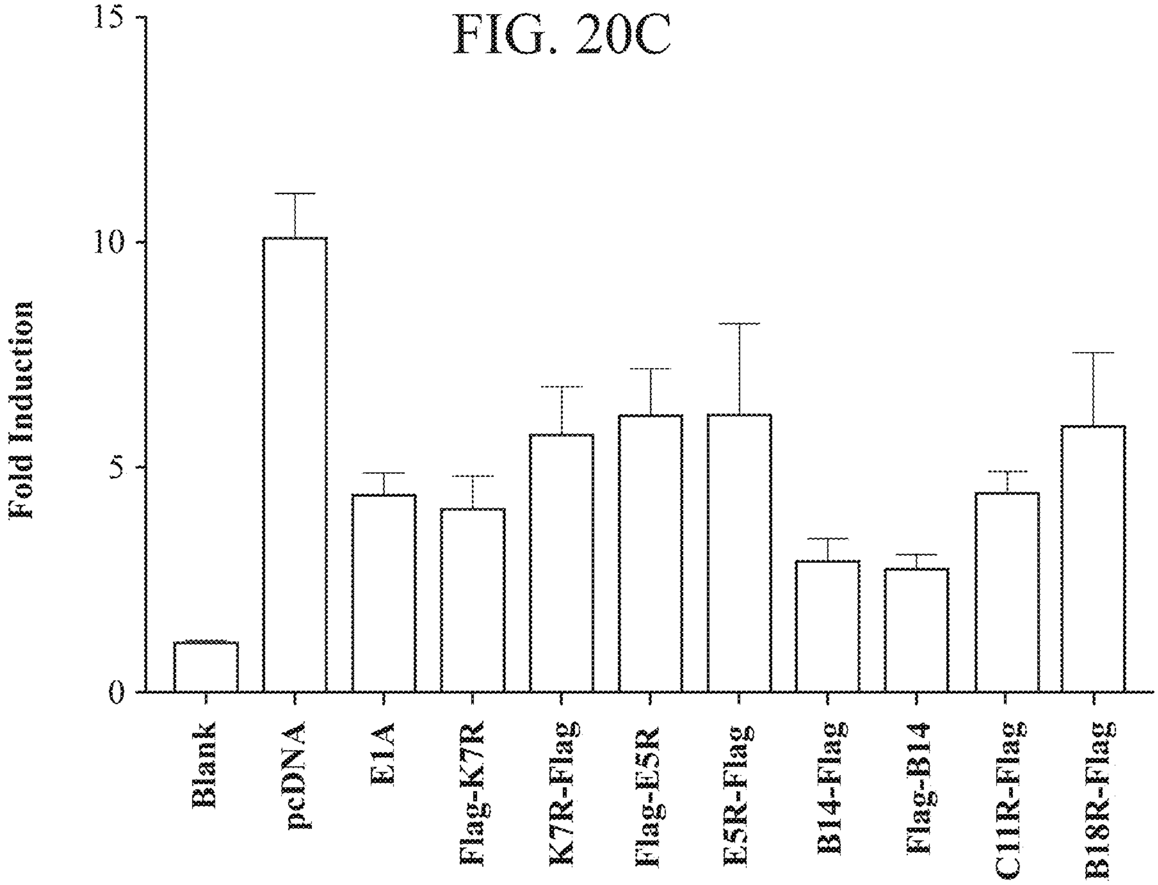
Figure 20D:
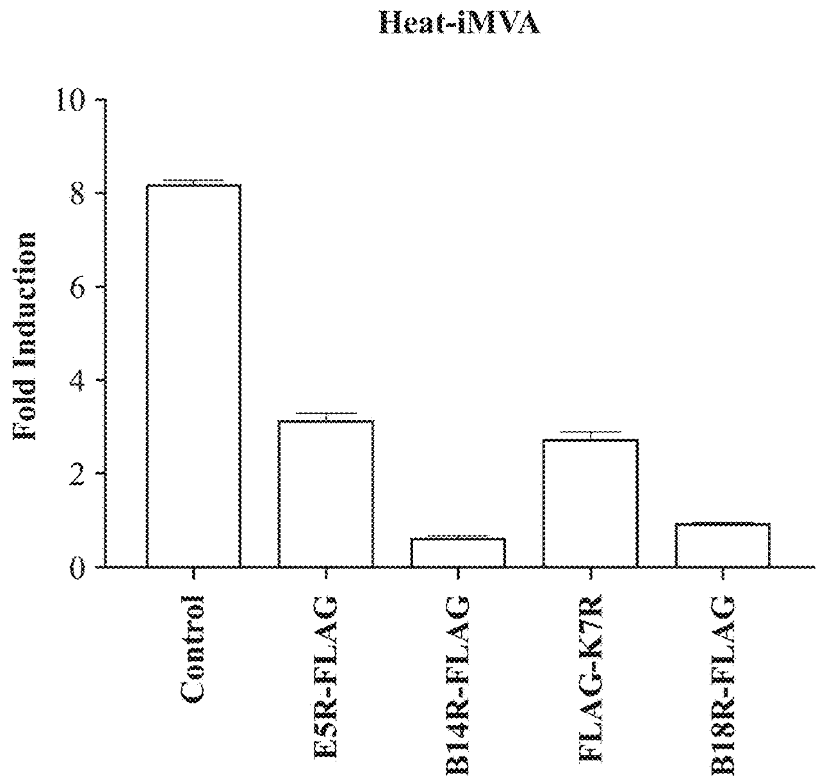
Figure 20E:
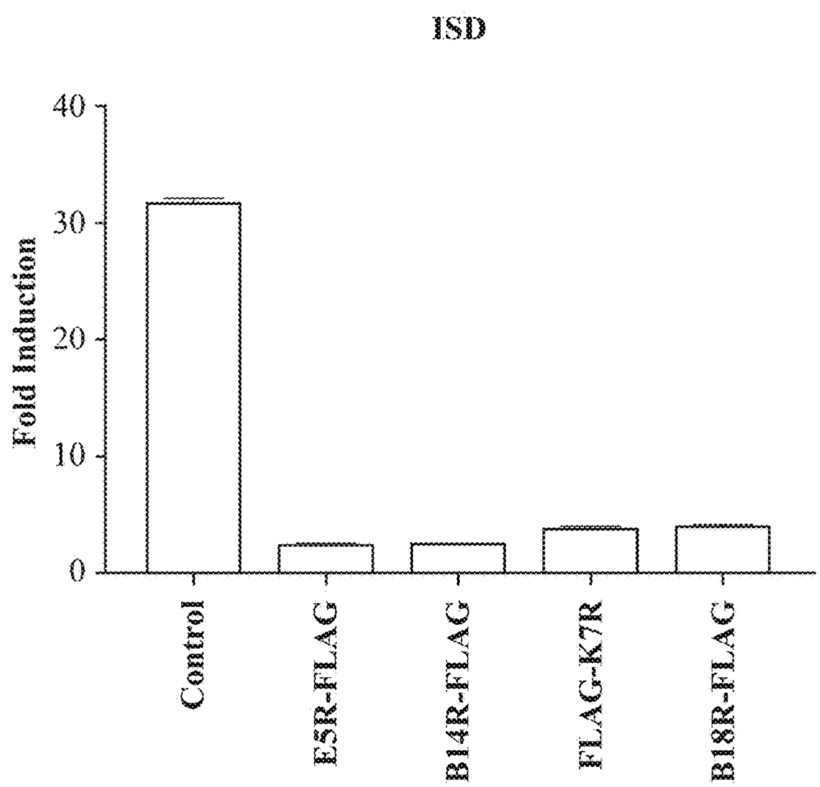

To confirm that B18R (WR200), E5R, K7R, C11R, and B14R play inhibitory roles in the cGAS/STING-induced IFNB gene expression, HEK293T-cells were co-transfected with plasmids expressing IFNB-firefly luciferase reporter, a control plasmid pRL-TK that expresses Renilla luciferase, murine cGAS (FIG. 20A), or human cGAS (FIG. 20B), human STING, individual vaccinia viral early gene as indicated, as well as E1A as a positive control. Overexpression of B18R (WR200), E5R, K7R, C11R, or B14R genes resulted in the reduction of IFNB gene expression induced by murine cGAS/human STING (FIG. 20A). Overexpression of E5R, K7R, C11R, or B14R genes resulted in the reduction of IFNB gene expression induced by human cGAS/human STING. However, overexpression of B18R (WR200) fails to inhibit IFNB gene expression induced by human cGAS/human STING (FIG. 20B). FIG. 20C shows that FLAG-tagged viral genes B18R (WR200), E5R, K7R, C11R or B14R were capable of inhibiting IFNB gene expression induced by murine cGAS/human STING.

Example 18: Over-expression of FLAG-tagged E5R, B14R, K7R, and B18R genes in a stable murine macrophage cell line inhibits IFNB gene expression induced by infection with Heat-inactivated MVA or transfection with immune-stimulating DNA.

Figure 21:
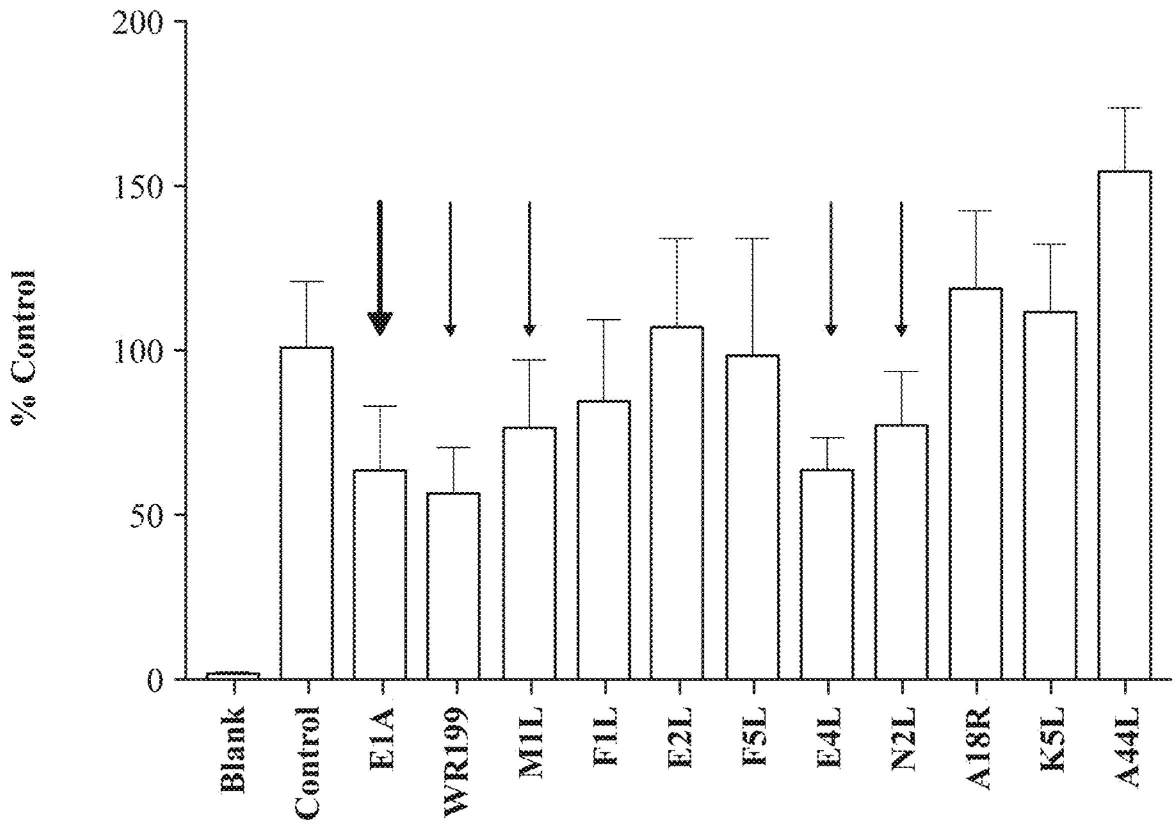
FIG. 21 shows additional dual luciferase screening results of vaccinia virus ORFs that inhibit cGAS/STING-dependent IFNβ-luc activity. HEK293T cells were transfected with plasmids expressing IFNβ-luc reporter, murine cGAS, human STING and vaccinia virus ORFs as indicated. Dual luciferase assays were performed 24 h after transfection. Adenovirus E1A gene was used as a positive control.

A stable cell line, RAW264.7, that overexpresses either E5R-FLAG, B14R-FLAG, FLAG-K7R, or B18R-FLAG genes was generated. Briefly, RAW264.7 were transduced with retrovirus containing the expression construct of vaccinia E5R-FLAG, B14R-FLAG, FLAG-K7R, or B18R-FLAG genes under CMV promoter and puromycin selection marker. Empty vector with drug selection marker was also used to generate a control cell line. Drug resistant cells were obtained and used for the following experiments. Cells were either infected with Heat-iMVA or transfected with immune-stimulating DNA (ISD) (10 μg/ml). At 12 h post treatment, cells were collected. RNAs were generated and quantitative RT-PCR was performed to evaluate the expression of IFNB gene. Infection with Heat-iMVA or treatment with ISD in the control cell line resulted in 8-and 32-fold induction of IFNB gene, respectively. The induction of IFNB was markedly reduced in cells over-expressing E5, B14, K7, or B18 (FIG. 21). These results indicate that vaccinia E5R, B14R, K7R, and B18R inhibit the cytosolic DNA-sensing pathway and blocks IFNB gene induction.

Example 19: Generation of recombinant MVAΔE5R, MVAΔK7R, or MVAΔB14R viruses.

To further establish the role of E5R, K7R, and B14R in immune modulation, the generation of MVAΔE5R, MVAΔK7R, and/or MVAΔB14R viruses will be established. pE5RGFP vector, pK7RGFP vector, or pB14RGFP vector will be constructed to insert a specific gene of interest (SG) into the E5R, K7R, or B14R loci of MVA. In this case, GFP under the control of the vaccinia P7.5 promoter will be used as a selection marker. BHK21 cells will be infected with MVA virus expressing LacZ at a MOI of 0.05 for 1 h, and then will be transfected with the plasmid DNA described above. The infected cells will be collected at 48 h. Recombinant viruses will be identified by their green fluorescence with the insertion of GFP into the E5R, K7R, or B14R loci. The positive clones will be plaque purified 4-5 times. PCR analysis will then be performed to confirm that the recombinant viruses MVAΔE5R, MVAΔK7R, or MVAΔB14R have lost the E5R, K7R, or B14R, respectively.

Example 20: MVAΔE5R, MVAΔK7R, or MVAΔB14R infection of cDCs induces higher levels of type I IFN gene expression than MVA.

MVA infection of conventional dendritic cells (cDCs) has been shown to induce type I IFN via a cGAS/STING/IRF3-dependent mechanism. To test whether E5R, K7R, or B14R plays an inhibitory role in the induction of cytosolic DNA-sensing pathway, the innate immune responses of bone marrow-derived DCs (BMDCs) to MVAΔE5R, MVAΔK7R, and/or MVAΔB14R vs. MVA will be analyzed. BMDCs will be infected with either MVAΔE5R, MVAΔK7R, MVAΔB14R, or MVA at a MOI of 10. Cells will be collected at 3 h and 6 h post infection. The type I IFN gene expression levels will be determined by quantitative PCR analyses. It is anticipated that MVAΔE5R, MVAΔK7R, or MVAΔB14R infection will induce significantly higher levels of type I IFN gene expression than MVA in cDCs at 3 h and 6 h post infection. To test whether MVAΔE5R, MVAΔK7R, or MVAΔB14R will induce higher levels of type I IFN gene activation in human immune cells, the widely used differentiated THP-1 cells will be employed. THP-1 cells will be infected with either MVAΔE5R, MVAΔK7R, MVAΔB14R, or MVA at a MOI of 10, and then will be collected at 3 h and 6 h post infection. It is anticipated that MVAΔE5R, MVAΔK7R, or MVAΔB14R infection will induce higher levels of type I IFN gene expression than MVA in THP-1 cells. These results will indicate that E5R, K7R, and/or B14R are inhibitors that antagonize the cytosolic DNA-sensing pathway. Accordingly, these results will show that MVAΔE5R, MVAΔK7R, and/or MVAΔB14R may be useful in methods of inducing the innate immune response.

Example 21: Generation of a cytokine producing recombinant modified vaccinia Ankara (MVA) virus using MVAΔC7L-hFlt3L-TK(−)-OX40L recombinant virus as a backbone to include E5R, K7R, and/or B14R deletions, and to express IL-2, IL-12, IL-18, IL-15, and/or IL-21 and its use in methods for treating solid tumors alone or in combination with immune checkpoint blockade agents.

This example describes the generation of a recombinant MVAΔC7L-hFlt3L-TK(−)-OX40L virus expressing transgenes IL-2, IL-12, IL-18, IL-15, and/or IL-21 from within either the E5R gene locus, the K7R gene locus, and/or the B14R gene locus and its use in methods for treating solid tumors alone or in combination with immune checkpoint blockade agents.

The recombinant virus will be engineered according to the homologous recombination methods described in the preceding examples. For example, expression cassettes will be designed to express IL-2, IL-12, IL-18, IL-15, and/or IL-21 using the vaccinia viral synthetic early and late promoter (PsE/L) and GFP or the *E. coli* xanthine-guanine phosphoribosyl transferase gene (gpt) under the control of the vaccinia P7.5 promoter used as a selection marker. The expression cassettes will be flanked by partial sequences of the gene into which the cassettes will be inserted via homologous recombination (e.g., the E5R gene, the K7R gene, or the B14R gene). BHK21 cells will be infected with recombinant vaccinia virus at a multiplicity of infection (MOI) of 0.05 for 1 h, and then will be transfected with the plasmid DNAs described above. The infected cells will be collected at 48 h. Recombinant viruses are selected through further culturing in gpt selection medium including MPA, xanthine and hypoxanthine, and plaque purified. PCR analysis will be performed to verify that the MVAΔC7L-hFlt3L-TK(−)-OX40L virus lacks the E5R gene, the K7R gene, and/or the B14R gene, but with IL-2, IL-12, IL-18, IL-15, and/or IL-21 insertion. The expression of the transgenes on murine B16-F10 cells and human SK-MEL-28 cells infected with the recombinant virus will be determined by FACS analysis using the appropriate antibody. It is anticipated that the majority of both murine B16-F10 and SK-MEL28 cells will express the transgene.

A bilateral tumor implantation model will be used to assess the anti-tumor efficacy of the recombinant viruses. Briefly, B16-F10 melanoma cells will be implanted intradermally into the shaved skin on the right ($5\times10^5$ cells) and left ($1\times10^5$ cells) flanks of a C57BL/6J mouse. After 7 to 8 days post implantation, the mice will be injected twice per week with: (i) PBS; (ii) intraperitoneal (IP) MVAΔC7L-hFlt3L-TK(−)-OX40L virus expressing transgenes IL-2, IL-12, IL-18, IL-15, and/or IL-21 from within either the E5R gene locus, the K7R gene locus, and/or the B14R gene locus; (iii) intratumoral (IT) MVAΔC7L-hFlt3L-TK(−)-OX40L virus expressing transgenes IL-2, IL-12, IL-18, IL-15, and/or IL-21 from within either the E5R gene locus, the K7R gene locus, and/or the B14R gene locus plus; (iv) intraperitoneal (IP) and intratumoral (IT) MVAΔC7L-hFlt3L-TK(−)-OX40L virus expressing transgenes IL-2, IL-12, IL-18, IL-15, and/or IL-21 from within either the E5R gene locus, the K7R gene locus, or the B14R gene locus; or (v) intratumoral (IT) MVAΔC7L-hFlt3L-TK(−)-OX40L virus expressing transgenes IL-2, IL-12, IL-18, IL-15, and/or IL-21 from within either the E5R gene locus, the K7R gene locus, and/or the B14R gene locus plus intraperitoneal (IP) immune checkpoint blockade agent (e.g., anti-PD-L1 antibody, anti-PD-1 antibody, anti-CTLA-4 antibody) when the mice are under anesthesia. The mice will be monitored for survival and the tumor sizes will be measured twice a week.

The results of this example will demonstrate the anti-tumor efficacy of MVAΔC7L-hFlt3L-TK(−)-OX40L virus expressing transgenes IL-2, IL-12, IL-18, IL-15, and/or IL-21 from within either the E5R gene locus, the K7R gene locus, and/or the B14R gene locus. It is anticipated that the IP and/or IT administration of MVAΔC7L-hFlt3L-TK(−)-OX40L virus expressing transgenes IL-2, IL-12, IL-18, IL-15, and/or IL-21 from within either the E5R gene locus, the K7R gene locus, and/or the B14R gene locus to mice with solid tumors will induce an anti-tumoral response, reduce tumor size, and/or increase survival. It is also anticipated that the combined administration of MVAΔC7L-hFlt3L-TK(−)-OX40L virus expressing transgenes IL-2, IL-12, IL-18, IL-15, and/or IL-21 from within either the E5R gene locus, the K7R gene locus, and/or the B14R gene locus and immune checkpoint blockade agent (e.g., anti-PD-L1antibody, anti-PD-1 antibody, anti-CTLA-4 antibody) will induce an anti-tumoral response, reduce tumor size, and/or increase survival. It is further anticipated that the combined administration of MVAΔC7L-hFlt3L-TK(−)-OX40L virus expressing transgenes IL-2, IL-12, IL-18, IL-15, and/or IL-21 from within either the E5R gene locus, the K7R gene locus, and/or the B14R gene locus and immune checkpoint blockade agent (e.g., anti-PD-L1 antibody, anti-PD-1 antibody, anti-CTLA-4 antibody) will produce synergistic effects in this regard as compared to the administration of MVAΔC7L-hFlt3L-TK(−)-OX40L virus expressing transgenes IL-2, IL-12, IL-18, IL-15, and/or IL-21 from within either the E5R gene locus, the K7R gene locus, and/or the B14R gene locus or immune checkpoint blockade therapy alone.

Accordingly, this example demonstrates that compositions of the present technology comprising recombinant MVAΔC7L-hFlt3L-TK(−)-OX40L viruses expressing transgenes IL-2, IL-12, IL-18, IL-15, and/or IL-21 from within either the E5R gene locus, the K7R gene locus, and/or the B14R gene locus alone or in combination with immune checkpoint blockade agents are useful in methods for treating solid tumors.

Example 22: Generation of recombinant vaccinia virus with deletion of E5R, K7R, or B14R (VACVΔE5R, VACVΔK7R, or VACVΔB14R).

pC7LGFP vector will be used to insert GFP under the control of the vaccinia P7.5 promoter into the E5R, K7R, or B14R loci of vaccinia virus (VACV). The expression cassette will be flanked by partial sequence of E5R, K7R, or B14R flank regions on each side. BSC40 cells will be infected with WT vaccinia virus expressing at a MOI of 0.05 for 1 h, and then will be transfected with the plasmid DNA described above. The infected cells will be collected at 48 h. Recombinant viruses will be identified by their green fluorescence with the insertion of GFP into the E5R, K7R, or B14R loci. The positive clones will then be plaque purified 4-5 times on BSC40 cells. PCR analysis will be performed to confirm that recombinant viruses VACVΔE5R, VACVΔK7R, or VACVΔB14R have lost the E5R, K7R, or B14R, respectively.

To determine if one of E5R, K7R, or B14R is a virulence factor and if VACVΔE5R, VACVΔK7R, or VACVΔB14R is highly attenuated compared to WT VACV, a murine intranasal infection model will be employed. Weight loss in C57BL/6J mice after intranasal infection with various doses of WT VACV will be compared to that observed in C57BL/6J after infection with VACVΔE5R, VACVΔK7R, or VACVΔB14R.

Example 23: Generation of a recombinant vaccinia virus with a TK deletion, disruption of the E3L gene, C7 deletion, and expressing hFlt3L, anti-CTLA-4, and OX40L (VACVΔE3L83N-hFlt3L-anti-CTLA-4-ΔC7L-OX40L) and its use in methods for treating solid tumors alone or in combination with immune checkpoint blockade agents.

This example describes the generation of a recombinant vaccinia E3LΔ83N virus comprising a TK deletion, a C7 deletion, and expressing an antibody that specifically targets cytotoxic T lymphocyte antigen 4 (anti-CTLA-4), hFlt3L, and OX40L and its use in methods for treating solid tumors alone or in combination with immune checkpoint blockade agents.

The virus is generated using plasmids containing expression cassettes designed to express one or more specific genes of interest (SG) (e.g., anti-CTLA-4, OX40L, hFtl3L). The expression cassettes are designed to express anti-CTLA-4, OX40L, and/or hFtl3L using the vaccinia viral synthetic early and late promoter (PsE/L) and GFP or the *E. coli* xanthine-guanine phosphoribosyl transferase gene (gpt) under the control of the vaccinia P7.5 promoter used as a selection marker. For example, an expression cassette is flanked by a partial sequence of C8L and C6R on the left and right side of C7L gene for insertion of a specific gene(s) of interest into the C7 locus via homologous recombination. An expression cassette may be flanked by the thymidine kinase (TK) gene on either side (TK-L, TK-R) for insertion of a specific gene(s) of interest into the TK locus via homologous recombination. BHK21 cells are infected with recombinant vaccinia virus at a multiplicity of infection (MOI) of 0.05 for 1 h, and then transfected with the plasmid DNAs described above. The infected cells are collected at 48 h. Recombinant viruses are selected through further culturing in selection medium including MPA, xanthine and hypoxanthine, and plaque purified. PCR analysis is performed to verify that VACVΔE3L83N-hFlt3L-anti-CTLA-4-ΔC7L-OX40L lacks C7L gene and part of the TK gene, but with hFlt3L, anti-CTLA-4, and OX40L insertion. The expression of OX40L on murine B16-F10 cells and human SK-MEL-28 cells infected with VACVΔE3L83N-hFlt3L-anti-CTLA-4-ΔC7L-OX40L virus is determined by FACS analysis using anti-OX40L antibody. It is anticipated that the majority of both murine B16-F10 and SK-MEL28 cells will express OX40L.

A bilateral tumor implantation model is used to assess the anti-tumor efficacy of the recombinant viruses. Briefly, B16-F10 melanoma cells are implanted intradermally into the shaved skin on the right ($5\times10^5$ cells) and left ($1\times10^5$ cells) flanks of a C57BL/6J mouse. After 7 to 8 days post implantation, the mice are injected twice per week with: (i) PBS; (ii) intraperitoneal (IP) VACVΔE3L83N-hFlt3L-anti-CTLA-4-ΔC7L-OX40L; (iii) intratumoral (IT) VACVΔE3L83N-hFlt3L-anti-CTLA-4-ΔC7L-OX40L; (iv) intraperitoneal (IP) and intratumoral (IT) VACVΔE3L83N-hFlt3L-anti-CTLA-4-ΔC7L-OX40L; or (v) intratumoral (IT) VACVΔE3L83N-hFlt3L-anti-CTLA-4-ΔC7L-OX40L plus intraperitoneal (IP) immune checkpoint blockade agent (e.g., anti-PD-L1 antibody, anti-PD-1 antibody, anti-CTLA-4 antibody) when the mice are under anesthesia. The mice are monitored for survival and the tumor sizes are measured twice a week.

The results of this example will demonstrate the anti-tumor efficacy of VACVΔE3L83N-hFlt3L-anti-CTLA-4-ΔC7L-OX40L. It is anticipated that the IP and/or IT administration of VACVΔE3L83N-hFlt3L-anti-CTLA-4-ΔC7L-OX40L to mice with solid tumors will induce an anti-tumoral response, reduce tumor size, and/or increase survival. It is also anticipated that the combined administration of VACVΔE3L83N-hFlt3L-anti-CTLA-4-ΔC7L-OX40L and immune checkpoint blockade agent (e.g., anti-PD-L1 antibody, anti-PD-1 antibody, anti-CTLA-4 antibody) will induce an anti-tumoral response, reduce tumor size, and/or increase survival. It is further anticipated that the combined administration of VACVΔE3L83N-hFlt3L-anti-CTLA-4-ΔC7L-OX40L and immune checkpoint blockade agent (e.g., anti-PD-L1 antibody, anti-PD-1 antibody, anti-CTLA-4 antibody) will produce synergistic effects in this regard as compared to the administration of VACVΔE3L83N-hFlt3L-anti-CTLA-4-ΔC7L-OX40L or immune checkpoint blockade therapy alone.

Accordingly, this example demonstrates that compositions of the present technology comprising recombinant VACVΔE3L83N-hFlt3L-anti-CTLA-4-ΔC7L-OX40L virus alone or in combination with immune checkpoint blockade agents are useful in methods for treating solid tumors.

Example 24: Generation of cytokine producing recombinant vaccinia virus using VACVΔE3L83N-hFlt3L-antiCTLA-4-ΔC7L-OX40L recombinant virus as a backbone to insert IL-2, IL-12, IL-18, IL-15, and/or IL-21 into the E5R, K7R, and/or B14R locus and its use in methods for treating solid tumors alone or in combination with immune checkpoint blockade agents.

This example describes the generation of a recombinant VACVΔE3L83N-hFlt3L-anti-CTLA-4-ΔC7L-OX40L virus expressing transgenes IL-2, IL-12, IL-18, IL-15, and/or IL-21 from within either the E5R gene locus, the K7R gene locus, and/or the B14R gene locus and its use in methods for treating solid tumors alone or in combination with immune checkpoint blockade agents.

The recombinant virus will be engineered according to the homologous recombination methods described in the preceding examples. For example, expression cassettes are designed to express IL-2, IL-12, IL-18, IL-15, and/or IL-21 using the vaccinia viral synthetic early and late promoter (PsE/L) and GFP or the *E. coli* xanthine-guanine phosphoribosyl transferase gene (gpt) under the control of the vaccinia P7.5 promoter used as a selection marker. The expression cassettes are flanked by partial sequences of the gene into which the cassettes will be inserted via homologous recombination (e.g., the E5R gene, the K7R gene, or the B14R gene). BHK21 cells are infected with recombinant vaccinia virus at a multiplicity of infection (MOI) of 0.05 for 1 h, and then transfected with the plasmid DNAs described above. The infected cells are collected at 48 h. Recombinant viruses are selected through further culturing in gpt selection medium including MPA, xanthine and hypoxanthine, and plaque purified. PCR analysis is performed to verify that the VACVΔE3L83N-hFlt3L-anti-CTLA-4-ΔC7L-OX40L virus lacks the E5R gene, the K7R gene, and/or the B14R gene, but with IL-2, IL-12, IL-18, IL-15, and/or IL-21 insertion. The expression of the transgenes on murine B16-F10 cells and human SK-MEL-28 cells infected with the recombinant virus is determined by FACS analysis using the appropriate antibody. It is anticipated that the majority of both murine B16-F10 and SK-MEL28 cells will express the transgene(s).

A bilateral tumor implantation model is used to assess the anti-tumor efficacy of the recombinant viruses. Briefly, B16-F10 melanoma cells are implanted intradermally into the shaved skin on the right ($5\times10^5$ cells) and left ($1\times10^5$ cells) flanks of a C57BL/6J mouse. After 7 to 8 days post implantation, the mice are injected twice per week with: (i) PBS; (ii) intraperitoneal (IP) VACVΔE3L83N-hFlt3L-anti-CTLA-4-ΔC7L-OX40L virus expressing transgenes IL-2, IL-12, IL-18, IL-15, and/or IL-21 from within the E5R gene locus, the K7R gene locus, and/or the B14R gene locus; (iii) intratumoral (IT) VACVΔE3L83N-hFlt3L-anti-CTLA-4-ΔC7L-OX40L virus expressing transgenes IL-2, IL-12, IL-18, IL-15, and/or IL-21 from within the E5R gene locus, the K7R gene locus, and/or the B14R gene locus plus; (iv) intraperitoneal (IP) and intratumoral (IT) VACVΔE3L83N-hFlt3L-anti-CTLA-4-ΔC7L-OX40L virus expressing transgenes IL-2, IL-12, IL-18, IL-15, and/or IL-21 from within the E5R gene locus, the K7R gene locus, and/or the B14R gene locus; or (v) intratumoral (IT) VACVΔE3L83N-hFlt3L-anti-CTLA-4-ΔC7L-OX40L virus expressing transgenes IL-2, IL-12, IL-18, IL-15, and/or IL-21 from within the E5R gene locus, the K7R gene locus, and/or the B14R gene locus plus intraperitoneal (IP) immune checkpoint blockade agent (e.g., anti-PD-L1 antibody, anti-PD-1 antibody, anti-CTLA-4 antibody) when the mice are under anesthesia. The mice are monitored for survival and the tumor sizes are measured twice a week.

The results of this example will demonstrate the anti-tumor efficacy of VACVΔE3L83N-hFlt3L-anti-CTLA-4-ΔC7L-OX40L virus expressing transgenes IL-2, IL-12, IL-18, IL-15, and/or IL-21 from within the E5R gene locus, the K7R gene locus, and/or the B14R gene locus. It is anticipated that the IP and/or IT administration of VACVΔE3L83N-hFlt3L-anti-CTLA-4-ΔC7L-OX40L virus expressing transgenes IL-2, IL-12, IL-18, IL-15, and/or IL-21 from within the E5R gene locus, the K7R gene locus, and/or the B14R gene locus to mice with solid tumors will induce an anti-tumoral response, reduce tumor size, and/or increase survival. It is also anticipated that the combined administration of VACVΔE3L83N-hFlt3L-anti-CTLA-4-ΔC7L-OX40L virus expressing transgenes IL-2, IL-12, IL-18, IL-15, and/or IL-21 from within the E5R gene locus, the K7R gene locus, and/or the B14R gene locus and immune checkpoint blockade agent (e.g., anti-PD-L1 antibody, anti-PD-1 antibody, anti-CTLA-4 antibody) will induce an anti-tumoral response, reduce tumor size, and/or increase survival. It is further anticipated that the combined administration of VACVΔE3L83N-hFlt3L-anti-CTLA-4-ΔC7L-OX40L virus expressing transgenes IL-2, IL-12, IL-18, IL-15, and/or IL-21 from within the E5R gene locus, the K7R gene locus, and/or the B14R gene locus and immune checkpoint blockade agent (e.g., anti-PD-L1 antibody, anti-PD-1 antibody, anti-CTLA-4 antibody) will produce synergistic effects in this regard as compared to the administration of VACVΔE3L83N-hFlt3L-anti-CTLA-4-ΔC7L-OX40L virus expressing transgenes IL-2, IL-12, IL-18, IL-15, and/or IL-21 from within the E5R gene locus, the K7R gene locus, and/or the B14R gene locus or immune checkpoint blockade therapy alone.

Accordingly, this example demonstrates that compositions of the present technology comprising recombinant VACVΔE3L83N-hFlt3L-anti-CTLA-4-ΔC7L-OX40L viruses expressing transgenes IL-2, IL-12, IL-18, IL-15, and/or IL-21 from within the E5R gene locus, the K7R gene locus, and/or the B14R gene locus alone or in combination with immune checkpoint blockade agents are useful in methods for treating solid tumors.

Example 25: Generation of a recombinant C7L mutant vaccinia virus with a TK deletion and expressing hFlt3L and OX40L (VACVΔC7L-TK(−)-hFlt3L-OX40L) and its use in methods for treating solid tumors alone or in combination with immune checkpoint blockade agents.

This example describes the generation of a recombinant VACVΔC7L-TK(−)-hFlt3L-OX40L virus and its use in methods for treating solid tumors alone or in combination with immune checkpoint blockade agents.

The virus is generated using plasmids containing expression cassettes designed to express one or more specific genes of interest (SG) (e.g., OX40L, hFtl13L). The expression cassettes are designed to express OX40L and/or hFtl3L using the vaccinia viral synthetic early and late promoter (PsE/L) and GFP or the *E. coli* xanthine-guanine phosphoribosyl transferase gene (gpt) under the control of the vaccinia P7.5 promoter used as a selection marker. For example, an expression cassette is flanked by a partial sequence of C8L and C6R on the left and right side of C7L gene for insertion of a specific gene(s) of interest (e.g., hFlt3L) into the C7 locus via homologous recombination.

An expression cassette may be flanked by the thymidine kinase (TK) gene on either side (TK-L, TK-R) for insertion of a specific gene(s) of interest (e.g., OX40L) into the TK locus via homologous recombination. BHK21 cells are infected with recombinant vaccinia virus at a multiplicity of infection (MOI) of 0.05 for 1 h, and then transfected with the plasmid DNAs described above. The infected cells are collected at 48 h. Recombinant viruses are selected through further culturing in selection medium including MPA, xanthine and hypoxanthine, and plaque purified. PCR analysis is performed to verify that VACVΔC7L-TK(−)-hFlt3L-OX40L lacks C7L gene and part of the TK gene, but with hFlt3L, and OX40L insertion. The expression of OX40L and hFlt3L on murine B16-F10 cells and human SK-MEL-28 cells infected with VACVΔC7L-TK(−)-hFlt3L-OX40L virus is determined by FACS analysis using anti-OX40L and anti-hFlt3L antibody. It is anticipated that both murine B16-F10 and SK-MEL28 cells will express OX40L and hFlt3L.

A bilateral tumor implantation model is used to assess the anti-tumor efficacy of the recombinant viruses. Briefly, B16-F10 melanoma cells are implanted intradermally into the shaved skin on the right ($5\times10^5$ cells) and left ($1\times10^5$ cells) flanks of a C57BL/6J mouse. After 7 to 8 days post implantation, the mice are injected twice per week with: (i) PBS; (ii) intraperitoneal (IP) VACVΔC7L-TK(−)-hFlt3L-OX40L; (iii) intratumoral (IT) VACVΔC7L-TK(−)-hFlt3L-OX40L virus; (iv) intraperitoneal (IP) and intratumoral (IT) VACVΔC7L-TK(−)-hFlt3L-OX40L virus; or (v) intratumoral (IT) VACVΔC7L-TK(−)-hFlt3L-OX40L virus plus intraperitoneal (IP) immune checkpoint blockade agent (e.g., anti-PD-L1 antibody, anti-PD-1 antibody, anti-CTLA-4 antibody) when the mice are under anesthesia. The mice are monitored for survival and the tumor sizes are measured twice a week.

The results of this example will demonstrate the anti-tumor efficacy of VACVΔC7L-TK(−)-hFlt3L-OX40L virus. It is anticipated that the IP and/or IT administration of VACVΔC7L-TK(−)-hFlt3L-OX40L virus to mice with solid tumors will induce an anti-tumoral response, reduce tumor size, and/or increase survival. It is also anticipated that the combined administration of VACVΔC7L-TK(−)-hFlt3L-OX40L virus and immune checkpoint blockade agent (e.g., anti-PD-L1 antibody, anti-PD-1 antibody, anti-CTLA-4 antibody) will induce an anti-tumoral response, reduce tumor size, and/or increase survival. It is further anticipated that the combined administration of VACVΔC7L-TK(−)-hFlt3L-OX40L virus and immune checkpoint blockade agent (e.g., anti-PD-L1 antibody, anti-PD-1 antibody, anti-CTLA-4 antibody) will produce synergistic effects in this regard as compared to the administration of VACVΔC7L-TK(−)-hFlt3L-OX40L virus or immune checkpoint blockade therapy alone.

Accordingly, this example demonstrates that compositions of the present technology comprising recombinant VACVΔC7L-TK(−)-hFlt3L-OX40L viruses alone or in combination with immune checkpoint blockade agents are useful in methods for treating solid tumors.

Example 26: Generation of a recombinant C7L mutant vaccinia virus with a TK deletion and expressing anti-CTLA-4, hFlt3L, OX40L, and hIL-12 (VACVΔC7L-anti-CTLA-4-TK(−)-hFlt3L-OX40L-hIL-12) and its use in methods for treating solid tumors alone or in combination with immune checkpoint blockade agents.

This example describes the generation of a recombinant VACVΔC7L-TK(−)-anti-CTLA-4-TK(−)-hFlt3L-OX40L-hIL-12 virus and its use in methods for treating solid tumors alone or in combination with immune checkpoint blockade agents.

The recombinant virus will be engineered according to the homologous recombination methods described in the preceding examples. For example, expression cassettes are designed to express anti-CTLA-4, hFlt3L, OX40L, and/or hIL-12 using the vaccinia viral synthetic early and late promoter (PsE/1) and GFP or the *E. coli* xanthine-guanine phosphoribosyl transferase gene (gpt) under the control of the vaccinia P7.5 promoter used as a selection marker. The expression cassettes are flanked by partial sequences of the gene into which the cassettes will be inserted via homologous recombination (e.g., the C7 gene, the TK gene, or any other suitable vaccinia viral gene). BHK21 cells are infected with recombinant vaccinia virus at a multiplicity of infection (MOI) of 0.05 for 1 h, and then transfected with the plasmid DNAs described above. The infected cells are collected at 48 h. Recombinant viruses are selected through further culturing in selection medium including MPA, xanthine and hypoxanthine, and plaque purified. PCR analysis is performed to verify that VACVΔC7L-TK(−)-anti-CTLA-4-TK(−)-hFlt3L-OX40L-hIL-12 lacks C7L gene and part of the TK gene, but with transgenes anti-CTLA-4, hFlt3L, OX40L, and hIL-12 insertion. The expression of transgenes in murine B16-F10 cells and human SK-MEL-28 cells infected with VACVΔC7L-TK(−)-anti-CTLA-4-TK(−)-hFlt3L-OX40L-hIL-12 virus is determined by FACS analysis using the appropriate antibodies. It is anticipated that both murine B16-F10 and SK-MEL28 cells will express the transgenes.

A bilateral tumor implantation model is used to assess the anti-tumor efficacy of the recombinant viruses. Briefly, B16-F10 melanoma cells are implanted intradermally into the shaved skin on the right ($5\times10^5$ cells) and left ($1\times10^5$ cells) flanks of a C57BL/6J mouse. After 7 to 8 days post implantation, the mice are injected twice per week with: (i) PBS; (ii) intraperitoneal (IP) VACVΔC7L-TK(−)-anti-CTLA-4-TK(−)-hFlt3L-OX40L-hIL-12; (iii) intratumoral (IT) VACVΔC7L-TK(−)-anti-CTLA-4-TK(−)-hFlt3L-OX40L-hIL-12virus; (iv) intraperitoneal (IP) and intratumoral (IT) VACVΔC7L-TK(−)-anti-CTLA-4-TK(−)-hFlt3L-OX40L-hIL-12virus; or (v) intratumoral (IT) VACVΔC7L-TK(−)-anti-CTLA-4-TK(−)-hFlt3L-OX40L-hIL-12 virus plus intraperitoneal (IP) immune checkpoint blockade agent (e.g., anti-PD-L1 antibody, anti-PD-1 antibody) when the mice are under anesthesia. The mice are monitored for survival and the tumor sizes are measured twice a week.

The results of this example will demonstrate the anti-tumor efficacy of VACVΔC7L-TK(−)-anti-CTLA-4-TK(−)-hFlt3L-OX40L-hIL-12 virus. It is anticipated that the IP and/or IT administration of VACVΔC7L-TK(−)-anti-CTLA-4-TK(−)-hFlt3L-OX40L-hIL-12 virus to mice with solid tumors will induce an anti-tumoral response, reduce tumor size, and/or increase survival. It is also anticipated that the combined administration of VACVΔC7L-TK(−)-anti-CTLA-4-TK(−)-hFlt3L-OX40L-hIL-12 virus and immune checkpoint blockade agent (e.g., anti-PD-L1 antibody, anti-PD-1 antibody) will induce an anti-tumoral response, reduce tumor size, and/or increase survival. It is further anticipated that the combined administration of VACVΔC7L-TK(−)-anti-CTLA-4-TK(−)-hFlt3L-OX40L-hIL-12 virus and immune checkpoint blockade agent (e.g., anti-PD-L1 antibody, anti-PD-1 antibody) will produce synergistic effects in this regard as compared to the administration of VACVΔC7L-TK(−)-anti-CTLA-4-TK(−)-hFlt3L-OX40L-hIL-12 virus or immune checkpoint blockade therapy alone.

Accordingly, this example demonstrates that compositions of the present technology comprising recombinant VACVΔC7L-TK(−)-anti-CTLA-4-TK(−)-hFlt3L-OX40L-hIL-12 viruses alone or in combination with immune checkpoint blockade agents are useful in methods for treating solid tumors.

Example 27: Co-Administration of MVAΔC7L-hFlt3L-TK(−)-mOX40L with Model Antigen, Chicken Ovalbumin (OVA), Enhances the Generation of OVA-specific $CD8^+$ and $CD4^+$ T-cells in the Spleen and Draining Lymph Nodes (dLNs), and Serum Anti-OVA IgG Antibodies in Immunized Mice.

This example will demonstrate that MVAΔC7L-hFlt3L-TK(−)-mOX40L can act as a vaccine adjuvant to enhance antigen presentation by dendritic cells (DCs). Mice are immunized subcutaneously (SC) with OVA (10 μg) with or without MVAΔC7L-hFlt3L-TK(−)-mOX40L ($1\times10^7$ pfu) twice, 2 weeks apart. Mice are euthanized 1 week after the second vaccination, with spleens, draining lymph nodes (dLNs), and blood subsequently collected for OVA-specific T-cell and antibody assessment. To determine anti-OVA $CD8^+$ T-cell responses, splenocytes (500,000 cells) are incubated with OVA 257-264 (SIINFEKL) peptide (SEQ ID NO: 15), which is a MHC class I ($K^b$)-restricted peptide epitope of OVA, for 12 h before they were stained for anti-CD8 and anti-IFN-γ antibodies. To test anti-OVA $CD4^-$ T-cell responses, splenocytes (500,000 cells) are incubated with OVA 323-339 (ISQAVHAAHAEINEAGR) peptide (SEQ ID NO: 16), which is a MHC class II I-$A^d$-restricted peptide epitope of OVA, for 12 h before they were stained for anti-CD4 and anti-IFN-γ antibodies. Co-administration of MVAΔC7L-hFlt3L-TK(−)-mOX40L with OVA SC is anticipated to result in the increase of anti-OVA IFN-$\gamma^+CD8^+$ T-cells and anti-OVA IFN-$\gamma^+CD4^+$ T-cells in the spleens compared with OVA alone.

A similar induction of anti-OVA IFN-$\gamma^+CD8^+$ T-cells and anti-OVA IFN-$\gamma^+CD8^+$ T-cells after SC OVA plus MVAΔC7L-hFlt3L-TK(−)-mOX40L is predicted to be observed in the dLNs. Briefly, single cell suspensions are generated from dLNs, and 500,000 cells are incubated with either OVA 257-264 or OVA 323-339 peptides. It is further anticipated that the combined administration of MVAΔC7L-hFlt3L-TK(−)-mOX40L and Heat-iMVA with OVA will produce synergistic effects in this regard as compared to the administration of MVAΔC7L-hFlt3L-TK(−)-mOX40L with OVA alone.

Example 28: MVAΔC7L-hFlt3L-TK(−)-mOX40L is Superior to Complete Freund Adjuvant (CFA) in Generating Antigen-Specific $CD8^+$ and $CD4^+$ T-cell Responses.

Complete Freund adjuvant (CFA) comprises heat-killed *Mycobacterium tuberculosis* in non-metabolizable oils (paraffin oil and mannide monooleate). It also contains ligands for TLR2, TLR4, and TLR9. Injection of antigen with CFA induces a Th1-dominant immune response. CFA's use in humans is currently impermissible due to its toxicity profile, and its use in animals is limited to subcutaneous or intraperitoneal routes due to painful reactions and risks of tissue damage at the site of injection. To test whether MVAΔC7L-hFlt3L-TK(−)-mOX40L is superior to CFA, mice are vaccinated subcutaneously with OVA antigen plus MVAΔC7L-hFlt3L-TK(−)-mOX40L or OVA plus CFA twice, 2 weeks apart, and subsequently harvested spleens, dLNs, and blood are harvested for anti-OVA $CD8^+$ and $CD4^+$ T-cell and antibody responses as described in Example 27.

It is anticipated that subcutaneous co-administration of OVA with MVAΔC7L-hFlt3L-TK(+)-mOX40L will induce higher levels of antigen-specific $CD8^+$ and $CD4^+$ T-cells compared with immunization with OVA plus CFA in the spleens of vaccinated mice.

Example 29: MVAΔC7L-hFlt3L-TK(−)-mOX40L is Superior to poly I:C or STING Agonist in Generating Antigen-Specific $CD8^+$ and $CD4^+$ T-cell Responses.

Poly IC and STING agonist are innate immune activators that have been investigated as vaccine adjuvants. To test whether MVAΔC7L-hFlt3L-TK(−)-mOX40L is superior to Poly IC and STING agonist, mice are vaccinated subcutaneously with OVA antigen plus MVAΔC7L-hFlt3L-TK(−)-mOX40L or OVA plus Poly IC and STING agonist twice, 2 weeks apart, and subsequently harvested spleens, dLNs, and blood are harvested for anti-OVA $CD8^+$ and $CD4^+$ T-cell and antibody responses as described in Example 27.

It is anticipated that subcutaneous co-administration of OVA with MVAΔC7L-hFlt3L-TK(−)-mOX40L will induce higher levels of antigen-specific CD8+ and CD4+ T-cells compared with immunization with OVA plus Poly IC and STING agonist in the spleens of vaccinated mice.

Example 30: Skin scarification with MVAΔC7L-hFlt3L-TK(−)-mOX40L-OVA generates stronger OVA-specific CD8+ and CD4+ T cells and antibody compared with MVA-OVA.

MVA is a highly attenuated, non-replicative, safe, and efficacious vaccine vector for various infectious agents and cancers. The optimal dosage for MVA vaccination is tested via skin scarification. MVA-OVA (which encodes full-length of OVA under the control of P7.5 promoter) or MVAΔC7L-hFlt3L-TK(−)-mOX40L-OVA at doses of $10^5$, $10^6$, and $10^7$ pfu are administered to the tails of 6-8 week old female C57BL/6J mice after skin scarification. One week after vaccination, mice are euthanized and the spleens are isolated for testing antigen-specific $CD8^+$ T-cell responses. Bone marrow-derived DCs (BMDCs) are infected with MVA-OVA at MOI of 5 for 1 h and then incubated for 5 h before the BMDCs are incubated with splenocytes for 12 h. Cells are processed for intracellular cytokine staining (ICS) for IFN-$\gamma^+CD8^+$ T-cells. Alternatively, BMDCs are incubated the SIINFEKL peptide (SEQ ID NO: 15) for 1 h and then incubated with splenocytes for 12 h. ICS is performed for IFN-$\gamma^+CD8^+$ T-cells reactive to SIINFEKL peptide (SEQ ID NO: 15).

To test whether STING or Batf3-dependent DCs, OX40 play a role in MVAΔC7L-hFlt3L-TK(−)-mOX40L-OVA-induced vaccination effects, MVAΔC7L-hFlt3L-TK(−)-mOX40L-OVA at a dose of $10^6$ pfu is also administered to the tails of $STING^{Gt/Gt}$, or $Batf3^{-/-}$, or $OX40^{-/-}$ mice after skin scarification. It is anticipated that this example will demonstrate that MVAΔC7L-hFlt3L-TK(−)-mOX40L-OVA is an improved vaccine vector compared with MVA-OVA, and its function requires STING, Batf3-dependent DCs, and OX40-OX40L interaction.

Example 31: MVAΔC7L-hFlt3L-TK(−)-mOX40L Induces MHC-I Expression of GM-CSF-Cultured Bone Marrow-Derived Dendritic Cells (BMDCs), But it Does Not Increase Phagocytosis of Antigen.

Infection of BMDCs with MVAΔC7L-hFlt3L-TK(−)-mOX40L induces DC maturation that is dependent on the STING-mediated cytosolic DNA-sensing pathway (Dai et al., *Science Immunology* 2017). In this example, the induction of MHC-I expression on the cell surface of BMDCs by MVAΔC7L-hFlt3L-TK(−)-mOX40L is compared with poly I:C. BMDCs are incubated with OVA in the presence or absence of MVAΔC7L-hFlt3L-TK(−)-mOX40L for 3 or 16 h, or with poly IC for 16 h. The cell surface MHC-I (H-$2K^b$) expression is determined by FACS using anti-H-$2K^b$ antibody. It is anticipated that co-incubation with MVAΔC7L-hFlt3L-TK(−)-mOX40L will increase the cell surface expression of H-$2K^b$. It is anticipated that the results will demonstrate that MVAΔC7L-hFlt3L-TK(−)-mOX40L is a stronger inducer of MHC-I expression on BMDCs compared with poly IC.

To assess whether BMDCs' capacity for uptake of fluorescent-labeled model antigen OVA (OVA-647) is affected by MVAΔC7L-hFlt3L-TK(−)-mOX40L treatment, BMDCs are infected with MVAΔC7L-hFlt3L-TK(−)-mOX40L (MOI of 1) for 1 h and then incubated with OVA-647 for 1 h. The fluorescence intensities of phagocytosed OVA-647 in BMDC are measured by flow cytometry. It is anticipated that the results of this experiment will demonstrate that although MVAΔC7L-hFlt3L-TK(−)-mOX40L-treated BMDCs undergo maturation, their capacity to phagocytose antigen is reduced as a consequence of maturation.

Example 32: Co-incubation of GM-CSF-Cultured BMDCs with MVAΔC7L-hFlt3L-TK(−)-mOX40L and OVA Enhances Proliferation of OT-I and OT-II T-cells in vitro.

Infection of epidermal dendritic cells with live WT vaccinia inhibits DCs' capacity to activate antigen-specific T-cells (Deng et al., JVI, 2006). To test whether MVAΔC7L-hFlt3L-TK(−)-mOX40L infection of BMDCs enhances the proliferation of antigen-specific OT-I and OT-II T-cells, BMDCs are incubated with OVA at various concentrations in the presence or absence of MVAΔC7L-hFlt3L-TK(−)-mOX40L for 3 h. Cells are washed to remove unabsorbed OVA or virus, and then co-cultured with Carboxyfluorescein Diacetate Succinimidyl Ester (CFSE)-labeled OT-I T-cells for 3 days (BMDC:OT-I T-cells=1:5). Flow cytometry is applied to measure CFSE intensities of OT-I cells. It is anticipated that pre-incubation with MVAΔC7L-hFlt3L-TK(−)-mOX40L will enhance the capacity of DCs to stimulate the proliferation of OT-I T-cells, as indicated by CSFE dilution in dividing cells. It is also anticipated that pre-treatment with MVAΔC7L-hFlt3L-TK(−)-mOX40L or poly IC enhances DCs' capacity to stimulate the proliferation of OT-II T-cells that recognize OVA-antigen presented by MHC-II on DCs. It is further anticipated that the combined administration of MVAΔC7L-hFlt3L-TK(−)-mOX40L and Heat-iMVA will produce synergistic effects in this regard as compared to the administration of MVAΔC7L-hFlt3L-TK(−)-mOX40L alone.

Example 33: Co-incubation of Flt3L-Cultured BMDCs with MVAΔC7L-hFlt3L-TK(−)-mOX40L and OVA Enhances the Proliferation of OT-I T-cells in vitro.

FMS-like tyrosine kinase 3 ligand (Flt3L) is a critical growth factor for the differentiation of Batf3-dependent $CD103^+$/$CD8\alpha^+$ DCs and plasmacytoid DCs (pDCs). Flt3L-cultured BMDCs are pulsed with OVA in the presence or absence of MVAΔC7L-hFlt3L-TK(−)-mOX40L, and then co-cultured with CFSE-labeled OT-I cells for 3 days (BMDC: OT-I=1:5). Flow cytometry is applied to measure CFSE intensities of OT-I cells. It is anticipated that MVAΔC7L-hFlt3L-TK(−)-mOX40L will stimulate the proliferation of OT-I cells, which recognizes $OVA_{257-264}$ (SIINFEKL) peptide (SEQ ID NO: 15) presented on MHC-I, even at very low concentrations of OVA. It is further anticipated that the combined administration of MVAΔC7L-hFlt3L-TK(−)-mOX40L and Heat-iMVA will produce synergistic effects in this regard as compared to the administration of MVAΔC7L-hFlt3L-TK(−)-mOX40L alone.

Example 34: Plasmacytoid Dendritic Cells (pDCs) Play Important Role in MVAΔC7L-hFlt3L-TK(−)-mOX40L-Mediated Vaccine Adjuvant Effects.

Plasmacytoid DCs (pDCs) can cross-present antigen to stimulate $CD8^+$ T-cell responses. To test whether pDCs play a role in MVAΔC7L-hFlt3L-TK(−)-mOX40L-mediated adjuvant effect in vivo, anti-PDCA-1 antibody is used one day prior and one day post intradermal immunization with OVA+MVAΔC7L-hFlt3L-TK(−)-mOX40L, which are performed on Day 0 and Day 14. Spleens and dLNs are isolated on day 21 for antigen-specific $CD8^+$ T-cell analyses. It is anticipated that intradermal co-administration of OVA+MVAΔC7L-hFlt3L-TK(−)-mOX40L increases the percentage of IFN-$\gamma^+$ T-cells among $CD8^+$ T-cells in the spleens. It is also anticipated that depletion of pDCs results in a decrease in the percentage of IFN-$\gamma^+$ T-cells among $CD8^+$ T-cells in the spleens. The results of this experiment are anticipated to demonstrate the role of pDCs in MVAΔC7L-hFlt3L-TK(−)-mOX40L-elicited vaccine adjuvant effects in a peptide vaccination model in vivo.

Example 35: Migratory Dendritic Cell Subsets $Langerin^-CD11b^-$ and $CD11b^+$ DCs are Efficient in OVA Antigen Uptake.

Many DC subsets are present in the lymph nodes, which include migratory DCs and resident DCs. Migratory DCs are $MHC\text{-}II^+CD11c^+$. Resident dendritic cell populations are $MHC\text{-}II^{Int}CD11c^+$. Migratory DCs can be further separated into $CD11b^+$ DC, $Langerin^-CD11b^-$ DC, and $Langerin^+$ DC. $Langerin^+$ DCs comprise of $CD103^+$ DC and Langerhans cells, whereas resident DCs are composed of $CD8\alpha^+$ resident DC and $CD8\alpha^-$ resident DC. To test which DCs subsets are efficient in phagocytosing OVA antigen labeled with fluorescent dye (OVA-647) and have the capacity to migrate to the dLNs, OVA-647 are injected intradermally (ID) to the right flank and harvested the dLNs at 24 h post injection. To compare whether co-administration of OVA-647 with or without vaccine adjuvants Addavax or MVAΔC7L-hFlt3L-TK(−)-mOX40L affects the percentages of OVA-$647^+$ cells among $Langerin^-CD11b^-$ and $CD11b^+$DCs, OVA-647 is intradermally (ID) injected with or without Addavax or MVAΔC7L-hFlt3L-TK(−)-mOX40L, and analyzed OVA-$647^+$ DCs among $Langerin^-CD11b^+$ and $CD11b^+$ DCs. It is anticipated that co-administration of OVA with MVAΔC7L-hFlt3L-TK(−)-mOX40L increases the percentages of OVA-$647^+$ cells among $Langerin^-CD11b^-$ and $CD11b^+$ DCs, whereas co-administration of OVA with Addavax fails to do the same. Addavax is a well-accepted squalene-based oil-in-water nano-emulsion with a formulation similar to MF59 that has been licensed in Europe for adjuvanted flu vaccines. It is anticipated that the results of this experiment will suggest that co-administration of OVA-647 with MVAΔC7L-hFlt3L-TK(−)-mOX40L enhances migratory DCs' capacity to transport phagocytosed antigen to the dLNs. It is further anticipated that the combined administration of MVAΔC7L-hFlt3L-TK(−)-mOX40L and Heat-iMVA will produce synergistic effects in this regard as compared to the administration of MVAΔC7L-hFlt3L-TK(−)-mOX40L alone.

Example 36: MVAΔC7L-hFlt3L-TK(−)-mOX40L is a Potent Immune Adjuvant for Irradiated Whole Cell Vaccine.

The advantage of using irradiated whole cell vaccines rather than peptide tumor antigen or neoantigen include: (i) tumor cells provide multiple tumor antigens that can be recognized by the host immune system; and (ii) can bypass the need or time to identify tumor antigens or neoantigens. Whether the addition of MVAΔC7L-hFlt3L-TK(−)-mOX40L with irradiated B16-OVA improves vaccination efficacy, and whether systemic delivery of anti-PD-L1 would further improve vaccination efficacy is analyzed. Mice are intradermally implanted with B16-OVA, they are vaccinated intradermally with irradiated B16-OVA, B16-OVA+MVAΔC7L-hFlt3L-TK(−)-mOX40L, or B16-OVA+poly IC three times at day 3, 6, and 9 on the contralateral flank.

It is anticipated that vaccination with irradiated B16-OVA+MVAΔC7L-hFlt3L-TK(−)-mOX40L will extend the median survival vs. Irradiated B16-OVA alone. It is also anticipated that, in the presence of anti-PD-L1 antibody, vaccination with irradiated B16-OVA+MVAΔC7L-hFlt3L-TK(−)-mOX40L will extend the median survival vs. Irradiated B16-OVA+anti-PD-L1. It is anticipated that these results will demonstrate that MVAΔC7L-hFlt3L-TK(−)-mOX40L is a potent and safe vaccine adjuvant for irradiated whole cell vaccination.

Example 37: MVAΔC7L-hFlt3L-TK(−)-mOX40L is an immune adjuvant for neoantigen peptide vaccination.

To test whether MVAΔC7L-hFlt3L-TK(−)-mOX40L can act as a vaccine adjuvant for neoantigen peptide vaccination, a subcutaneous vaccination model was used in which mice are first implanted with B16-F10 cells ($7.5\times10^4$ cells per mouse) intradermally. At day 3, 7, and 10 post implantation, mice are vaccinated at the contralateral flank subcutaneously (SC) with either a mixture of neoantigen peptides (M27 (REGVELCPGNKYEMRRHGTTHSL VIHD) (SEQ ID NO: 17), M30 (PSKPSFQEFVDWENVSPELNSTDQPFL) (SEQ ID NO: 18), and M48 (SHCHWNDLAVIPAGVVHNWDFEPRKVS) (SEQ ID NO: 19)) with or without either MVAΔC7L-hFlt3L-TK(−)-mOX40L or poly I:C. Tumor growth and mice survival are monitored. It is anticipated that SC vaccination with neoantigen peptides alone generates systemic antitumor immunity and the antitumor effect is enhanced when neoantigen peptide mix are co-administered with MVAΔC7L-hFlt3L-TK(−)-mOX40L.

Example 38: MVAΔC7L-hFlt3L-TK(−)-mOX40L is an immune adjuvant for viral antigen peptide vaccination.

Viral antigens are potent immunogens that can be recognized by the host immune system. To test whether the combination of MVAΔC7L-hFlt3L-TK(−)-mOX40L and viral antigen (such as synthetic long peptide (SLP) of human papilloma virus E7) elicits antiviral T cells, mice will be subcutaneously vaccinated with E7 SLP alone, or E7 SLP plus MVAΔC7L-hFlt3L-TK(−)-mOX40L, or E7 plus poly I:C twice, two weeks apart, and spleens are subsequently harvested, dLNs, and blood are harvested for anti-$CD8^+$ and $CD4^+$ T-cell and antibody responses. To test the role of MVAΔC7L-hFlt3L-TK(−)-mOX40L in the therapeutic vaccination model, E7-expressing cancer cells (TC-1) will be implanted intradermally, and then the vaccination will be performed with or without adjuvant two weeks apart, and tumor volumes and mice survival will be followed.

Example 39: Skin scarification with MVAΔC7L-hFlt3L-TK(−)-mOX40L-E7 Generates a Stronger anti-E7 CD8+ and CD4+ T cell Responses Compared with MVA-E7.

Recombinant MVAΔC7L-hFlt3L-TK(−)-mOX40L virus expressing HPV E7 gene will be generated by inserting HPV E7 gene under the control of vaccinia psE/L promoter into MVA E5R or K7R loci. MVA-E7 (which encodes full-length of HPV E7 under the control of psE/L promoter inserted in the TK locus) or MVAΔC7L-hFlt3L-TK(−)-mOX40L-E7 at doses of $10^6$ or $10^7$ pfu are administered to the tails of 6-8 week old female C57BL/6J mice after skin scarification. One week after vaccination, mice are euthanized and the spleens are isolated for testing antigen-specific $CD8^+$ T-cell responses. Bone marrow-derived DCs (BMDCs) are infected with MVA-E7 at MOI of 5 for 1 h and then incubated for 5 h before the BMDCs are incubated with splenocytes for 12 h. Cells are processed for intracellular cytokine staining (ICS) for IFN-$\gamma^+CD8^+$ T-cells. Alternatively, BMDCs are incubated the E7 peptide for 1 h and then incubated with splenocytes for 12 h. ICS is performed for IFN-$\gamma^+CD8^+$ T-cells reactive to E7 peptide.

Example 40: Intranasal Infection of MVAΔC7L-hFlt3L-TK(−)-mOX40L-E7 Provides Better Protection of Mice from TC-1 Cells (expressing E7) Growth in the Lungs Compared with MVA-E7.

Six-eight week-old female C57BL/6J mice are intranasally infected with MVAΔC7L-hFlt3L-TK(−)-mOX40L-E7, or MVA-E7 (at $2\times10^7$ pfu), or PBS control. One week after intranasal infection, mice are challenged with $1\times10^5$ TC-1 cells through tail-vein injection. Mice are euthanized 3 weeks later to evaluate tumor growth in the lungs. It is anticipated that vaccination with MVAΔC7L-hFlt3L-TK(−)-mOX40L-E7 provides better protection against E7-expressing tumor cell growth in the lungs compared with MVA-E7.

Example 41: Test Whether Intratumoral (IT) Vaccination is Superior to Subcutaneous (SC) Vaccination in Generating Antigen-Specific Immune Responses.

Rationale: It was previously shown that intratumoral (IT) injection of Heat-iMVA eradicates injected tumors and induces systemic antitumor immunity, which requires Batf3-dependent $CD103^+/CD8\alpha^+$ DCs and STING-mediated cytosolic DNA-sensing pathway. IT delivery of Heat-iMVA alters tumor immunosuppressive microenvironment partially through activating cGAS/STING pathway and promotes tumor antigen presentation by the $CD103^+$ DCs. It is hypothesized that IT delivery of Heat-iMVA plus model antigen or neoantigen would enhance antigen presentation by tumor-infiltrating DCs and generate superior adaptive immunity compared with SC delivery of Heat-iMVA plus antigen.

Methods: To test whether IT vaccination is superior to SC vaccination in generating antigen-specific immune responses, B16-F10 melanoma cells ($5\times10^5$ cells) will be intradermally implanted at the right flank. At day 7 post implantation, when the tumors are 2-3 mm in diameter, MVAΔC7L-hFlt3L-TK(−)-mOX40L and OVA protein will either be directly injected into the tumors or injected SC 1 cm away from the tumors on the right flank. At one week post injection, TDLNs and spleens will be collected and anti-OVA CD4 and CD8 T cells will be analyzed by FACS.

Alternatively, B16-F10 neoantigen peptide mix (M27/M30/M48) will be co-injected with MVAΔC7L-hFlt3L-TK(−)-mOX40L either directly into the tumors on the right flank, or injected SC 1 cm away from the tumors on the right flank. At one week post injection, TDLNs and spleens will be collected and co-cultured with either M27 (REGVELCPGNKYEMRRHGTTHSL VIHD) (SEQ ID NO: 17), M30 (PSKPSFQEFVDWENVSPELNSTDQPFL) (SEQ ID NO: 18), or M48 (SHCHWND-LAVIPAGVVHNWDFEPRKVS) (SEQ ID NO: 19) peptide for 16 h for ELISPOT analysis.

Example 42: Test Whether Intratumoral (IT) Vaccination is Superior to Subcutaneous (SC) Vaccination in Generating Antigen-Specific Immune Responses in the Presence of Immune Checkpoint Blockade.

To test whether IT vaccination is superior to SC vaccination in generating antigen-specific immune responses in the presence of immune checkpoint blockade antibodies, including anti-CTLA-4, anti-PD-1, or anti-PD-L1, B16-F10 melanoma cells ($5\times10^5$ cells) will be intradermally implanted at the right flank. At day 7 post implantation, when the tumors are 2-3 mm in diameter, MVAΔC7L-hFlt3L-TK(−)-mOX40L and OVA protein will either be directly injected into the tumors or injected SC 1 cm away from the tumors on the right flank twice, three days apart. Anti-CTLA-4, anti-PD-1, or anti-PD-L1, or isotype control antibody will be administered intraperitoneally twice, three days apart. At 2 days post second injection, TDLNs and spleens will be collected and anti-OVA CD4 and CD8 T cells will be analyzed by FACS.

Alternatively, B16-F10 neoantigen peptide mix (M27/M30/M48) will be co-injected with MVAΔC7L-hFlt3L-TK(−)-mOX40L either directly into the tumors on the right flank, or injected SC 1 cm away from the tumors on the right flank twice, three days apart. Anti-CTLA-4, anti-PD-1, or anti-PD-L1, or isotype control antibody will be administered intraperitoneally twice, three days apart. At 2 days post second injection, TDLNs and spleens will be collected and co-cultured with either M27, M30, or M48 peptide for 16 h for ELISPOT analysis.

Example 43: E3LΔ83N-TK$^-$-hFlt3L-anti-muCTLA-4/C7L$^-$-mOX40L or VAC-TK$^-$-anti-muCTLA-4/C7L$^-$-mOX40L recombinant viruses are replication competent.

Figure 24A:
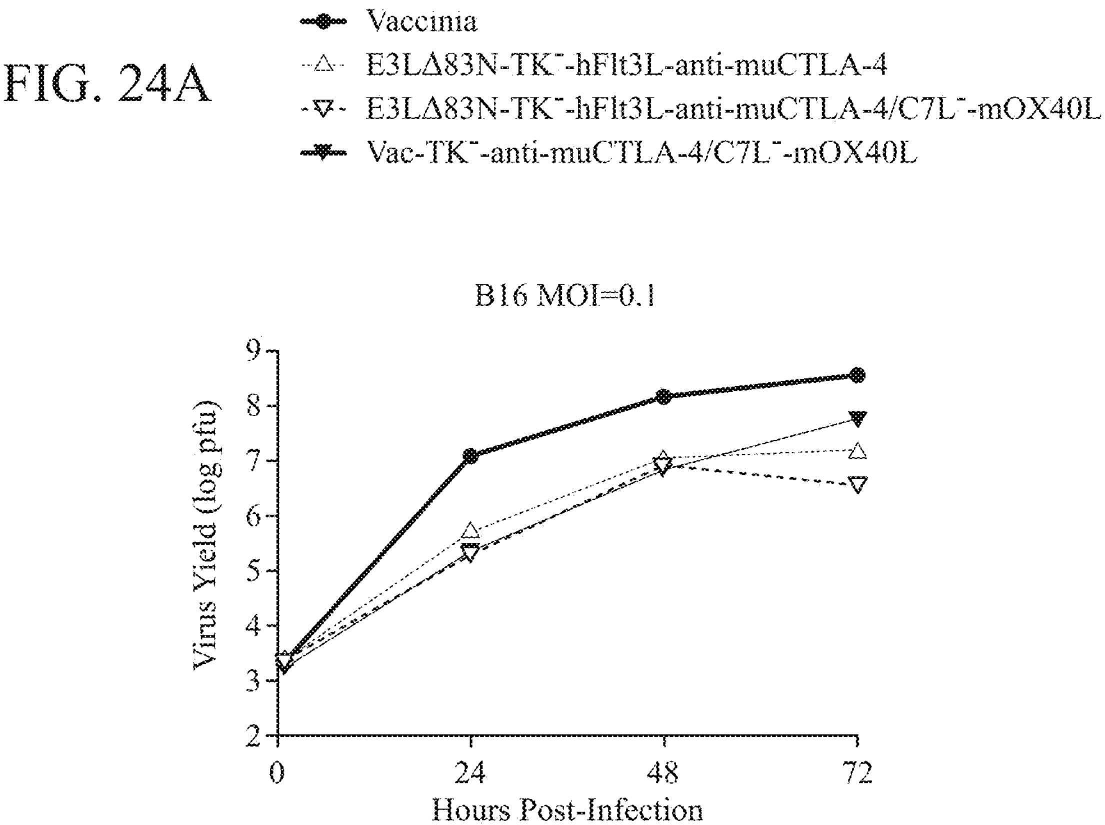
FIG. 24A and 24B are two graphs showing a multi-step growth of the vaccinia and the recombinant viruses, including E3LΔ83N-TK⁻-hFlt3L-anti-muCTLA-4, E3LΔ83N-TK⁻-hFlt3L-anti-muCTLA-4/C7L⁻-mOX40L, and VAC-TK⁻-anti-muCTLA-4/C7L⁻-mOX40L in murine B16-F10 melanoma cells.
Figure 24B:
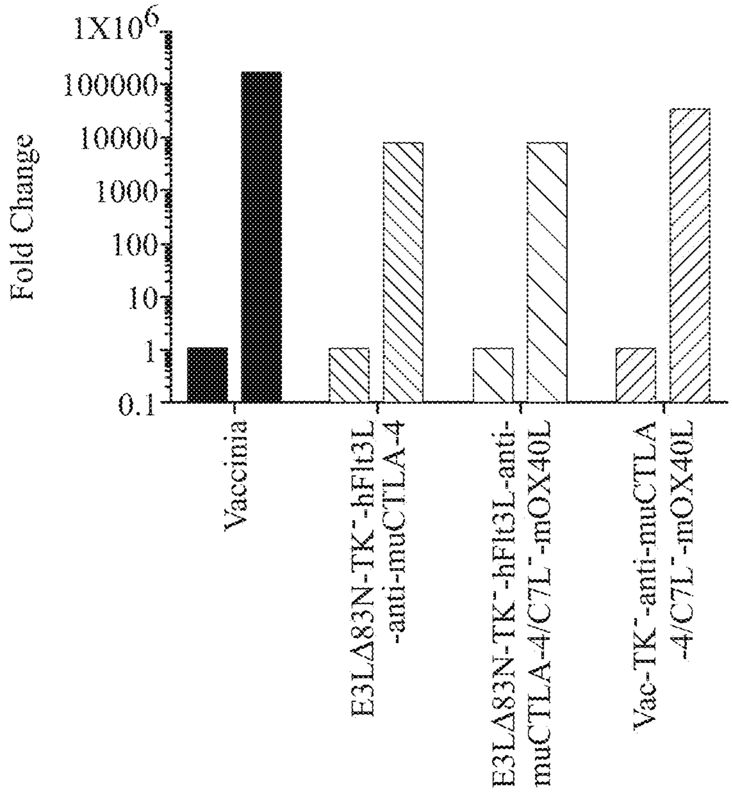

The replication capacities of E3LΔ83N-TK$^-$-hFl3L-anti-muCTLA-4/C7L$^-$-mOX40L or VAC-TK$^-$-anti-muCTLA-4/C7L$^-$-mOX40L were determined in murine B16-F10 melanoma cells by infecting them at a MOI of 0.1. Cells were collected at various time points post infection (e.g., 1, 24, 48, and 72 h) and viral yields (log pfu) were determined by titrating on BSC40 cells. FIG. 24A shows the graphs of viral yields plotted against hours post infection. Both E3LΔ83N-TK$^-$-hFl3L-anti-muCTLA-4/C7L$^-$-mOX40L and VAC-TK$^-$-anti-muCTLA-4/C7L$^-$-mOX40L replicated efficiently in B16-F10 cells with viral titers increasing by more than 1421 and 32142-fold at 72 h post-infection, respectively. The fold changes of viral yields at 72 h over those at 1 h post infection were calculated (FIG. 24B). The recombinant viruses E3LΔ83N-TK$^-$-hFl3L-anti-muCTLA-4/C7L$^-$-mOX40L and VAC-TK$^-$-anti-muCTLA-4/C7L$^-$-mOX40L have replicated efficiently in murine B16-F10 melanoma cells.

TABLE 6

Quantitative data (fold change at 72 hpi) for results shown in FIGS. 24A and 24B.

| | Vaccinia | E3LΔ83N-TK-hFlt3L-anti-muCTLA-4 | E3LΔ83N-TK-hFlt3L-anti-muCTLA-4/C7L mOX40L | VAC-TK-anti-muCTLA-4/C7L-mOX40L |
|---|---|---|---|---|
| B16-F10 | 161111 | 7052 | 1421 | 32142 |

Figure 25:
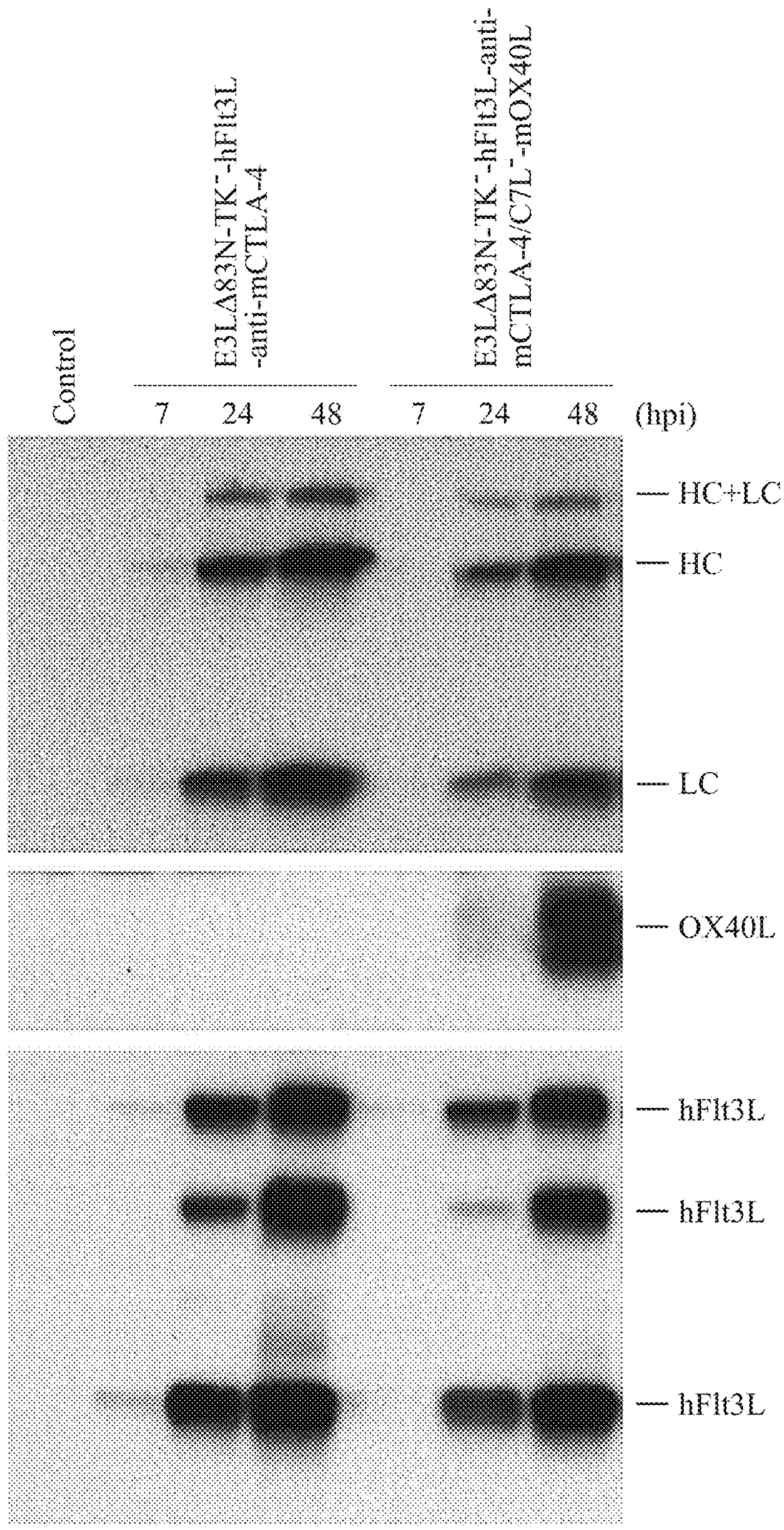
FIG. 25 shows a Western blot analysis of anti-mCTLA-4 antibody, murine OX40L, and human Flt3L expression in E3LΔ83N-TK⁻-hFlt3L-anti-muCTLA-4 or E3LΔ83N-TK⁻-hFlt3L-anti-muCTLA-4/C7L⁻-mOX40L virus-infected murine B16-F10 melanoma cells. B16-F10 cells were infected or mock infected with E3LΔ83N-TK⁻-hFlt3L-anti-muCTLA-4 or E3LΔ83N-TK⁻-hFlt3L-anti-muCTLA-4/C7L⁻-mOX40L viruses at a MOI of 10. Cell lysates were collected at 7, 24 and 48 h post infection, and the polypeptides in cell lysates were separated using 10% SDS-PAGE. HRP-conjugated anti-mouse IgG (heavy and light chain), anti-mOX40L antibody, and anti-human Flt3L antibody was used to detect the anti-mCTLA-4 antibody, murine OX40L, and human Flt3L protein respectively.

Example 44: Expression of anti-muCTLA-4, hFlt3L, and mOX40L in B16-F10 melanoma cells via infection of E3LΔ83N-TK$^-$-hFlt3L-anti-muCTLA-4/C7L$^-$-mOX40L virus To determine whether E3LΔ83N-TK$^-$-hFlt3L-anti-muCTLA-4/C7L$^-$-mOX40L recombinant viruses are capable of expressing desired specific genes, B16-F10 murine melanoma cells were infected with E3LΔ83N-TK$^-$-hFlt3L-anti-muCTLA-4 or E3LΔ83N-TK$^-$-hFlt3L-anti-muCTLA-4/C7L$^-$-mOX40L at a MOI of 10, and the expression of anti-muCTLA-4, hFlt3L and mOX40L was measured. Cell lysates were collected at various times (e.g., 7, 24, and 48 h) post infection. Western blot analyses were performed to determine the levels of the antibodies and proteins. As shown in FIG. 25, there is abundant expression of anti-muCTLA-4 antibody (Heavy Chain (HC) and Light Chain (LC)), hFl3L, and mOX40L protein in B16-F10 cells infected with E3LΔ83N-TK$^-$-hFl3L-anti-muCTLA-4/C7L$^-$-mOX40L virus. Accordingly, these results demonstrate that the recombinant viruses of the present technology have the capacity to simultaneously express multiple specific genes of interest from different loci in the virus in infected cells and are useful in methods for delivering the desired products to cells.

Example 45: Cell surface expression of mOX40L in B16-F10 melanoma cells via infection of E3LΔ83N-TK$^-$-hFlt3L-anti-muCTLA-4/C7L$^-$-mOX40L or VAC-TK$^-$-anti-muCTLA-4/C7L$^-$-mOX40L viruses.

To determine whether mOX40L is expressed on the surface of murine B16-F10 cells infected with E3LΔ83N-TK$^-$-hFlt3L-anti-muCTLA-4/C7L$^-$-mOX40L or VAC-TK$^-$-anti-muCTLA-4/C7L$^-$-mOX40L recombinant viruses, B16-F10 cells were infected with E3LΔ83N-TK$^-$-hFlt3L-anti-muCTLA-4, E3LΔ83N-TK$^-$-hFlt3L-anti-muCTLA-4/C7L$^-$-mOX40L, or VAC-TK$^-$-anti-muCTLA-4/C7L$^-$-mOX40L at a MOI of 10. The cell surface mOX40L expression is determined by FACS using anti-mOX40L antibody at 24 h post infection. As shown in FIG. 26, there is abundant cell surface expression of mOX40L protein in murine B16-F10 cells infected with E3LΔ83N-TK⁻-hFl3L-anti-muCTLA-4/C7L⁻-mOX40L or VAC-TK⁻-anti-muCTLA-4/C7L⁻-mOX40L viruses. Accordingly, these results demonstrate that the recombinant viruses of the present technology have the capacity to express specific genes of interest in infected cells and are useful in methods for delivering the desired products to cells and the cell surface.

Example 46: The combination with IT delivery of MVAΔC7L-hFlt3L-TK(−)-mOX40L and systemic delivery of anti-PD-L1 antibody significantly increases the overall responses and cure rate in B16-F10 melanoma unilateral implantation model.

Figure 28A:
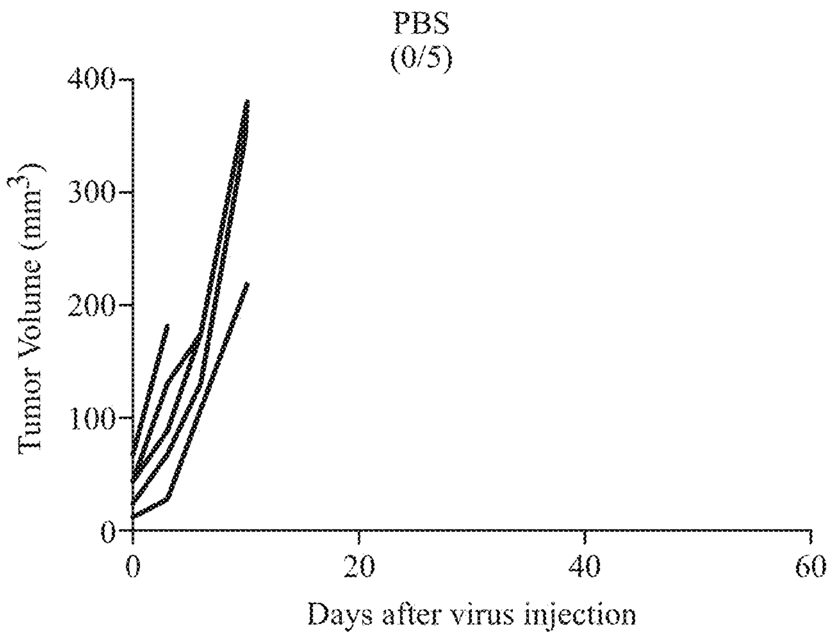
Figure 28B:
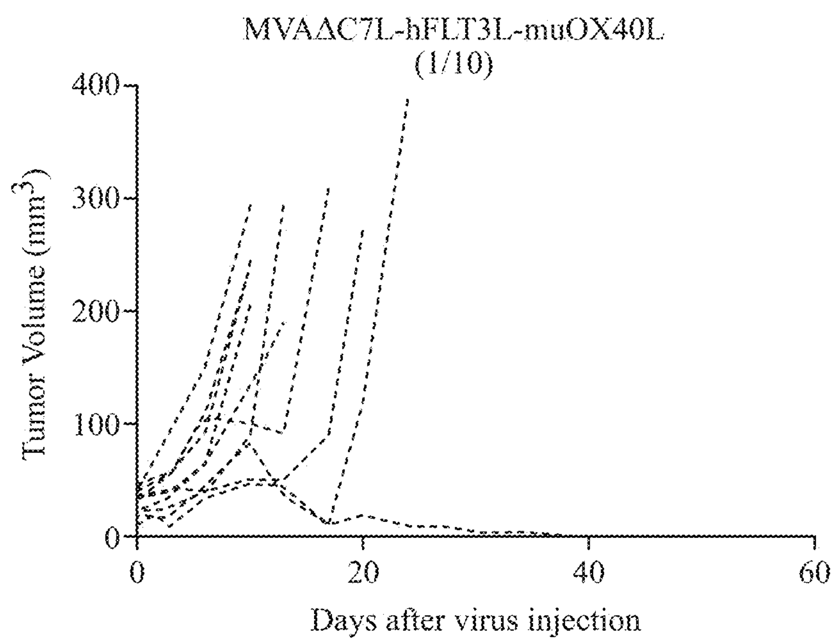

The combination with IT delivery of MVAΔC7L-hFlt3L-TK(−)-mOX40L and systemic delivery of anti-PD-L1 demonstrated superior anti-tumor efficacy in a murine B16-F10 melanoma unilateral implantation model. Briefly, $5\times10^5$ B16-F10 melanoma cells were implanted intradermally into the shaved skin on the right flanks of C57BL/6J mice. 9 days post implantation, the tumors were injected twice a week with PBS or $4\times10^7$ pfu of MVAΔC7L-hFlt3L-TK(−)-mOX40L. Anti-PD-L1 antibody were given intraperitoneally at 250 μg per mouse (FIG. 27). Tumor volumes of individual mice were measured (FIGS. 28A-28C) and the overall survival rate of mice was monitored (FIGS. 29A-29B). Intratumoral injection of MVAΔC7L-hFlt3L-TK(−)-mOX40LC7LhFl3LmOX40Ldelayed tumor growth and improved survival compared with PBS, with a median survival of 13 days. The combination of IT MVAΔC7L-hFlt3L-TK(−)-mOX40LC7LhFl3LmOX40Land IP anti-PD-L1 antibody showed better anti-tumor efficacy in eradicating tumors compared with MVAΔC7L-hFlt3L-TK(−)-mOX40LC7LhFl3LmOX40Lalone, with 60% of mice tumor-free and survived after treatments.

Example 47: The combination with IT delivery of MVAΔC7L-hFlt3L-TK(−)-mOX40L and systemic delivery of anti-PD-L1 antibody significantly increases the overall responses and cure rate in MC38 colon cancer unilateral implantation model.

Figure 30:
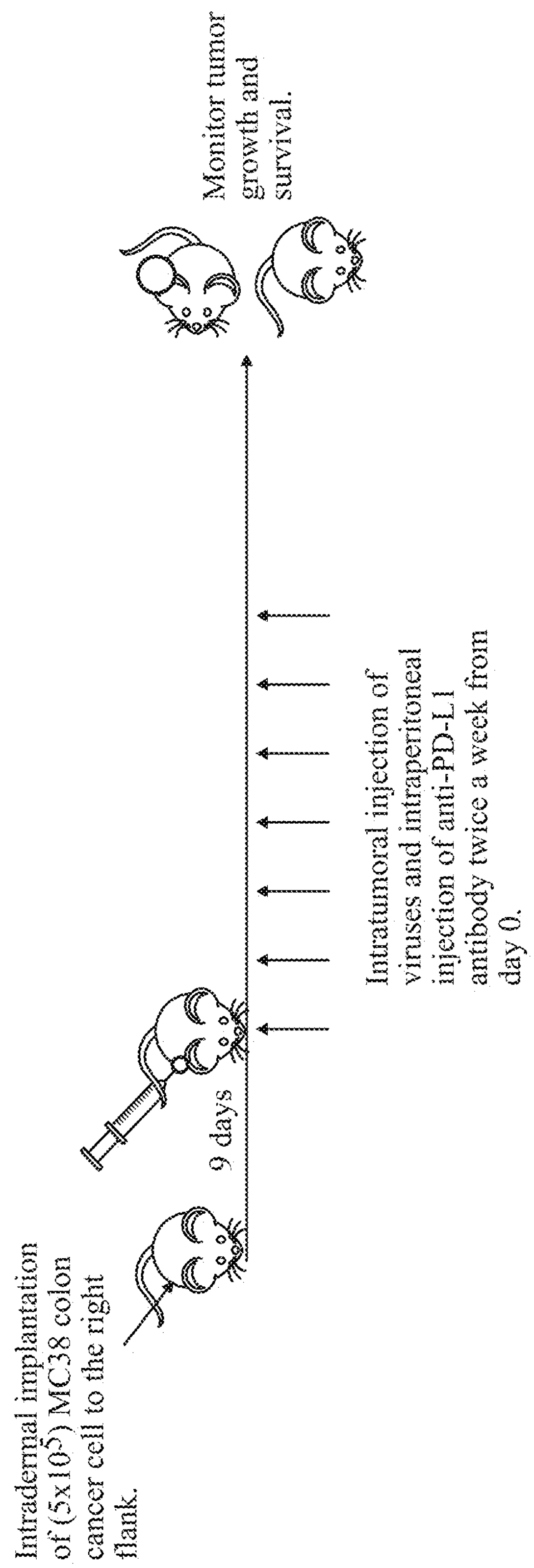
FIG. 30 shows a scheme of tumor implantation and treatment for a MC38 unilateral tumor implantation model. Briefly, $5\times10^5$ MC38 melanoma cells were implanted intradermally to the right flank of C57B/6J mice. Nine days post tumor implantation, $4\times10^7$ pfu of MVAΔC7L-hFlt3L-TK(−)mOX40L were intratumorally injected twice weekly. Anti-PD-1 antibody at 250 μg per mouse was given intraperitoneally. The tumor sizes were measured and the survival of mice was monitored.
Figure 31A:
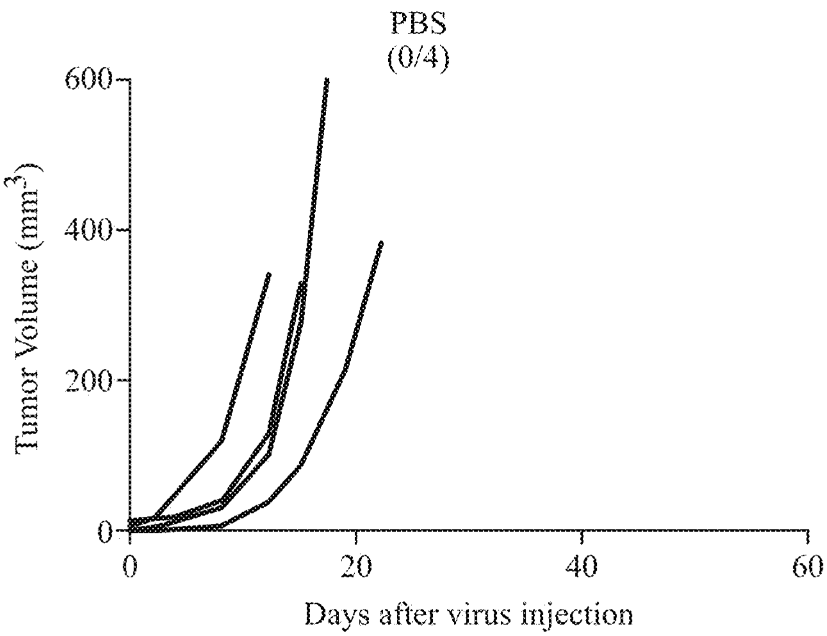
Figure 31B:
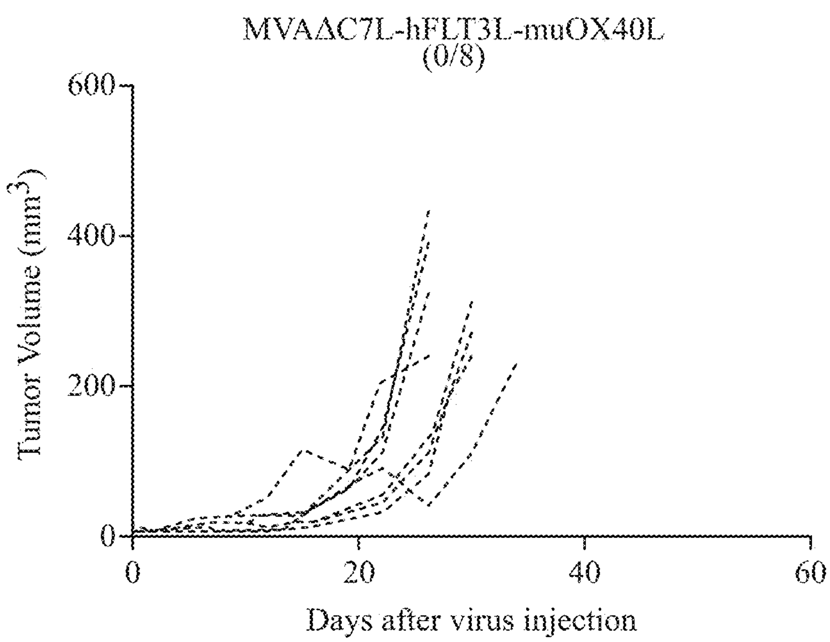

The combination with IT delivery of MVAΔC7L-hFlt3L-TK(−)-mOX40L and systemic delivery of anti-PD-L1 had superior anti-tumor efficacy in MC38 colon cancer unilateral implantation model. Briefly, $5\times10^5$ MC38 cells were implanted intradermally into the shaved skin on the right flanks of C57BL/6J mice. 9 days post implantation, the tumors were injected twice a week with PBS or $4\times10^7$ pfu of MVAΔC7L-hFlt3L-TK(−)-mOX40L. Anti-PD-L1 antibody were given intraperitoneally at 250 μg per mouse (FIG. 30). Tumor volumes of individual mice were measured (FIGS. 31A-31C) and the overall survival rate of mice was monitored (FIGS. 32A-32B). Intratumoral injection of MVAΔC7L-hFl3L-TK(−)-mOX40L delayed tumor growth and prolonged survival compared with PBS, with extension of median survival to 28 days. The combination of IT MVAΔC7L-hFl3L-TK(−)-mOX40L and IP anti-PD-L1 antibody showed better anti-tumor efficacy in eradicating tumors compared with MVAΔC7L-hFlt3L-TK(−)-mOX40LC7LhFl3LmOX40Lalone, with 62.5% of mice tumor-free and survived after treatments.

Example 48: The combination with IT delivery of MVAΔC7L-hFlt3L-TK(−)-mOX40L and systemic delivery of anti-PD-L1 antibody significantly increases the overall responses and cure rate in MB49 bladder cancer unilateral implantation model.

Figure 33:
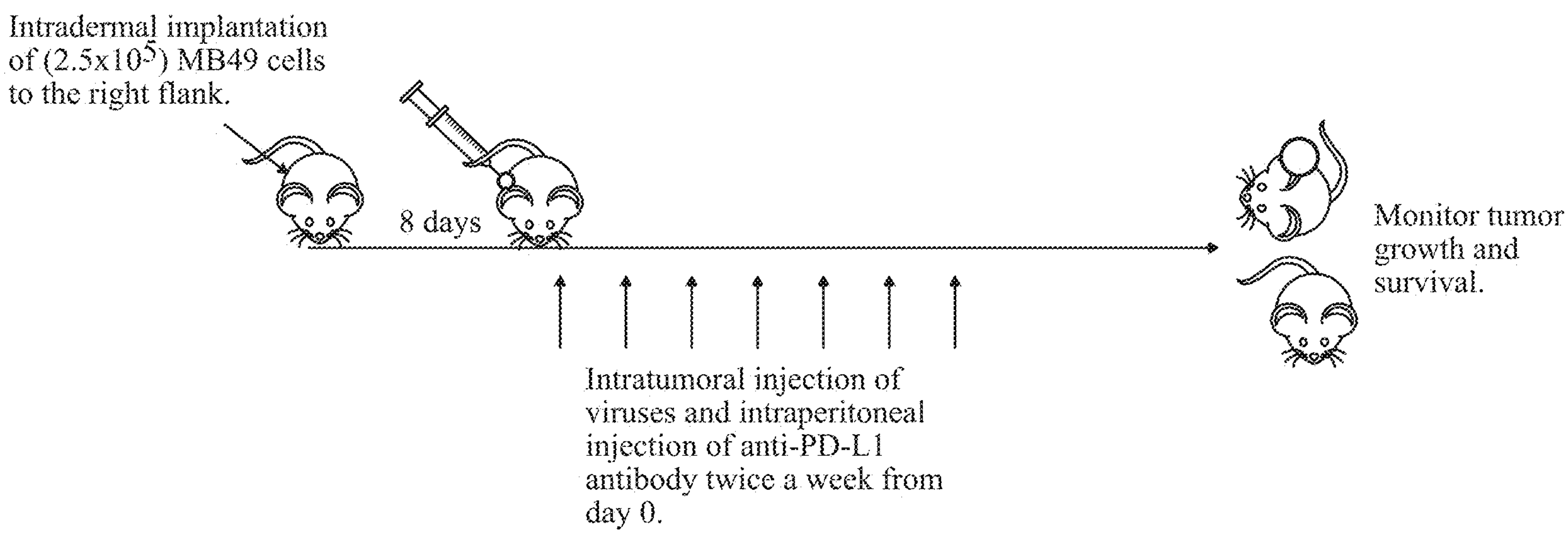
FIG. 33 shows a scheme of tumor implantation and treatment for a MB49 unilateral tumor implantation model. Briefly, $2.5\times10^5$ MB49 melanoma cells were implanted intradermally to the right flank of C57B/6J mice. Eight days post tumor implantation, $4\times10^7$ pfu of MVAΔC7L-hFlt3L-TK(−)mOX40L were intratumorally injected twice weekly. Anti-PD-L1 antibody at 250 μg per mouse was given intraperitoneally. The tumor sizes were measured and the survival of mice was monitored.
Figure 34A:
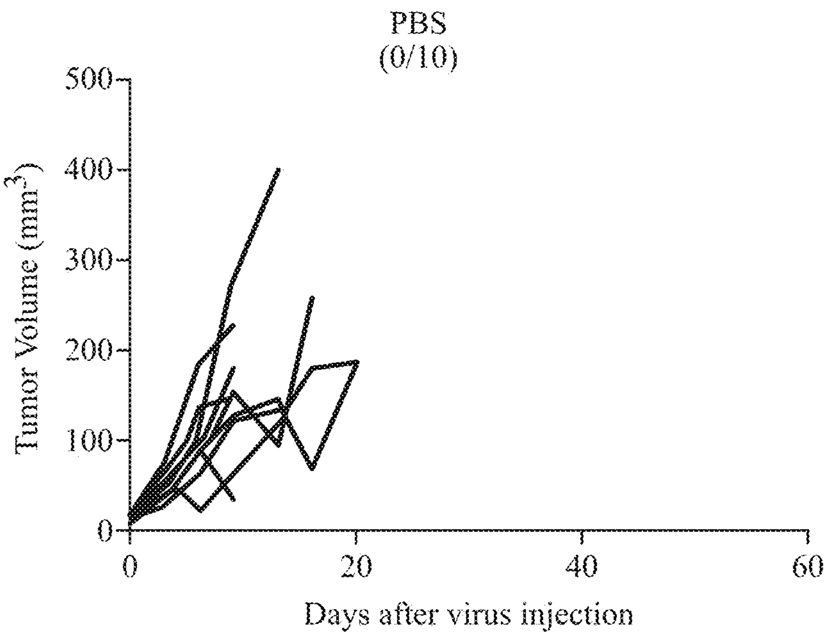
FIGS. 34A-34D are graphical representations of data showing volumes of tumors over days after PBS (FIG. 34A), MVAΔC7L-hFlt3L-TK(−)-mOX40L (FIG. 34B), MVAΔC7L-hFlt3L-TK(−)-mOX40L plus anti-PD-L1 antibody (FIG. 34V), or anti-PD-L1 antibody (FIG. 34D) treatments.
Figure 34B:
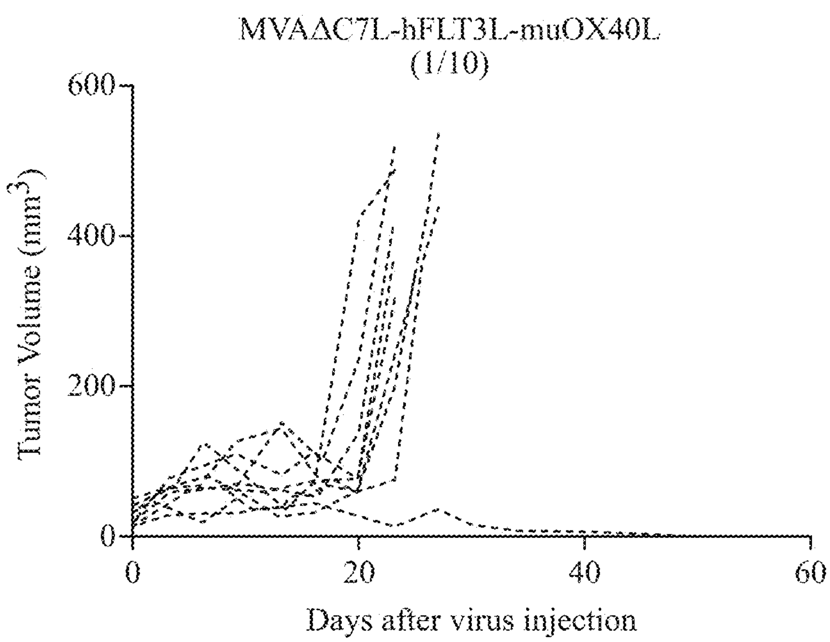
Figure 34C:
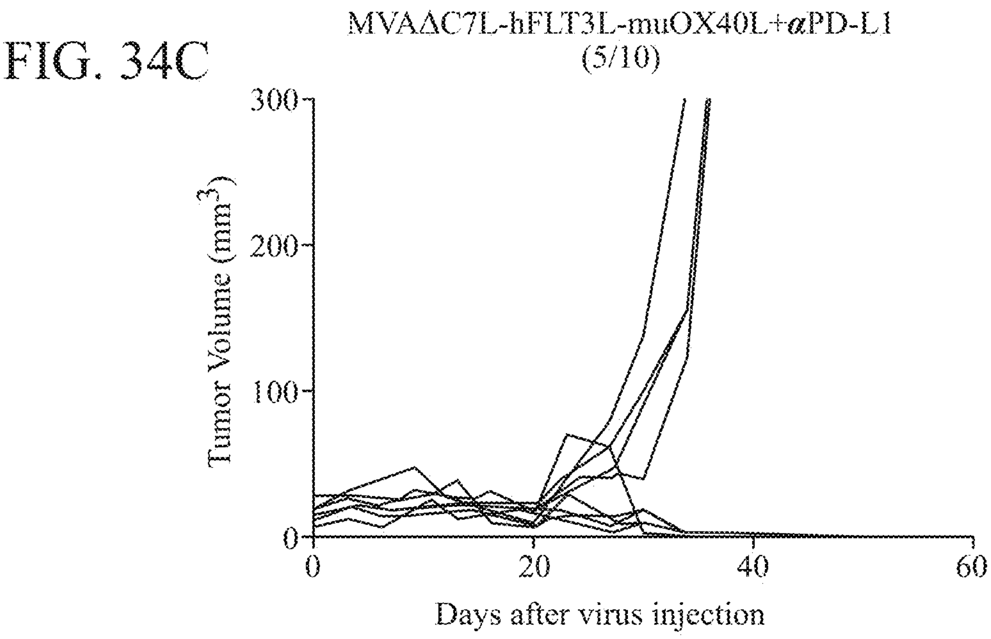
Figure 34D:
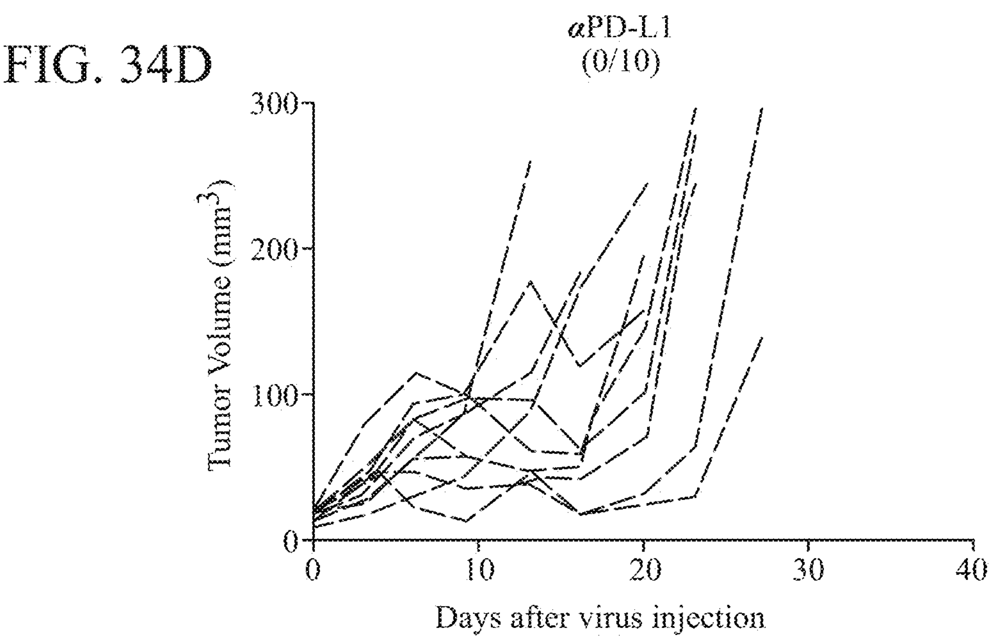
Figures 35A, 35B:
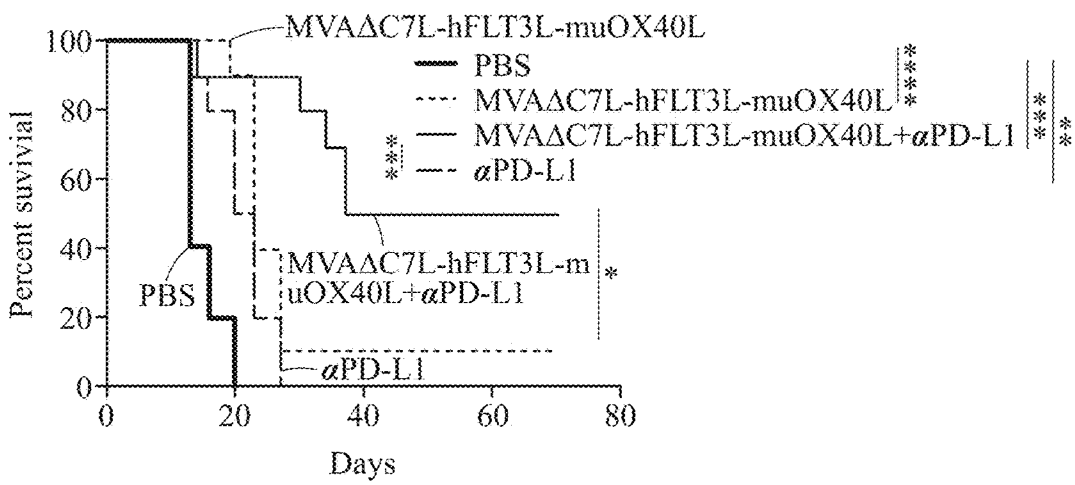
FIGS. 35A and 35B demonstrate survival studies of mice treated with either PBS, MVAΔC7L-hFlt3L-TK(−)-mOX40L, MVAΔC7L-hFlt3L-TK(−)-mOX40L plus anti-PD-L1 antibody, or anti-PD-L1 antibody treatments.

The combination with IT delivery of MVAΔC7L-hFlt3L-TK(−)-mOX40L and systemic delivery of anti-PD-L1 had superior anti-tumor efficacy in MB49 bladder cancer unilateral implantation model. Briefly, $2.5\times10^5$ MB49 cells were implanted intradermally into the shaved skin on the right flanks of C57BL/6J mice. 8 days post implantation, the tumors were injected twice a week with PBS or $4\times10^7$ pfu of MVAΔC7L-hFlt3L-TK(−)-mOX40L, or the mice were administered anti-PD-L1 antibody twice a week. Anti-PD-L1 antibody were given intraperitoneally at 250 μg per mouse (FIG. 33). Tumor volumes of individual mice were measured (FIGS. 34A-34D) and the overall survival rate of mice was monitored (FIGS. 35A-35B). In mice treated with PBS, the tumors grew rapidly, which resulted in early death with median survival of 13 days. Intratumoral injection of MVAΔC7L-hFlt3L-TK(−)-mOX40LC7LhFl3LmOX40Ldelayed tumor growth and prolonged survival compared with PBS, with extension of median survival to 23 days. IP delivery of anti-PD-L1 antibody alone received partial responses with delayed tumor growth and extended median survival to 21.5 days compared with PBS but mice were unable to reject tumors. The combination of IT MVAΔC7L-hFlt3L-TK(−)-mOX40LC7LhFl3LmOX40Land IP anti-PD-L1 antibody are more effective in eradicating MB49 tumors compared with MVAΔC7L-hFlt3L-TK(−)-mOX40LC7LhFl3LmOX40Lalone or anti-PD-L1 antibody alone with extended median survival to 43.5 days. 50% of mice were tumor-free and survived after treatments Example 49: Spontaneous breast cancers are responsive to the combination therapy with IT delivery of MVAΔC7L-hFlt3L-TK(−)-mOX40L and systemic delivery of anti-PD-L1 antibody.

Figure 36:
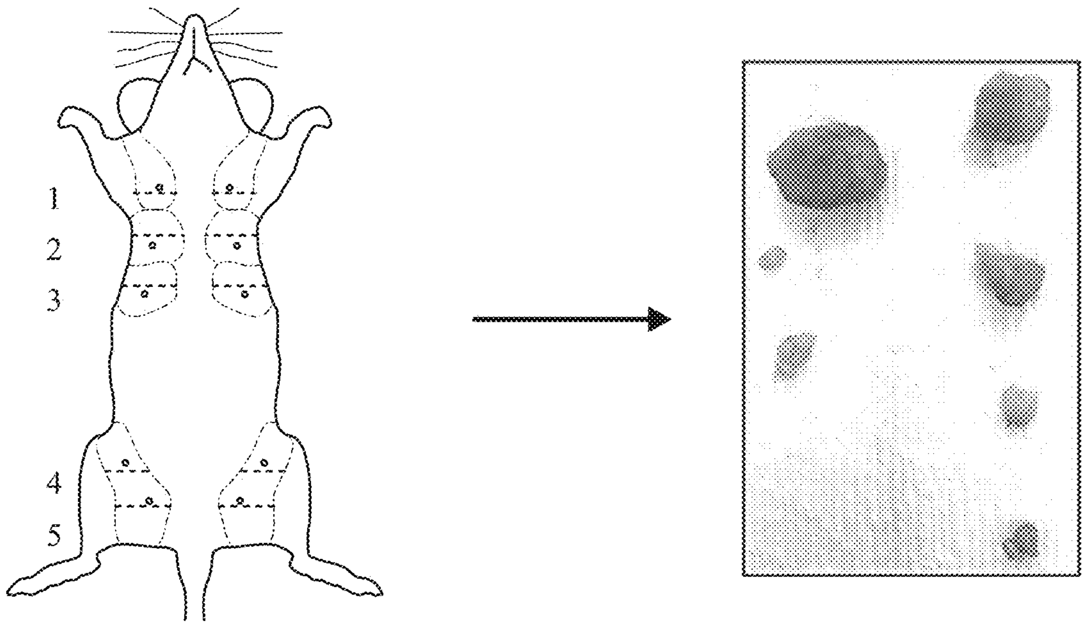
FIG. 36 shows a representative graph of tumors isolated from a female MMTV-PyVmT mouse. Briefly, the mice were treated with IT injection of PBS, $4\times10^7$ pfu of MVAΔC7L-hFlt3L-TK(−)-mOX40L twice weekly after developing palpable mammary tumors with a mean latency of 92 days of age. Anti-PD-L1 antibody at 250 μg per mouse was given intraperitoneally twice weekly. The tumor sizes were measured and the survival of mice was monitored.
Figure 37:
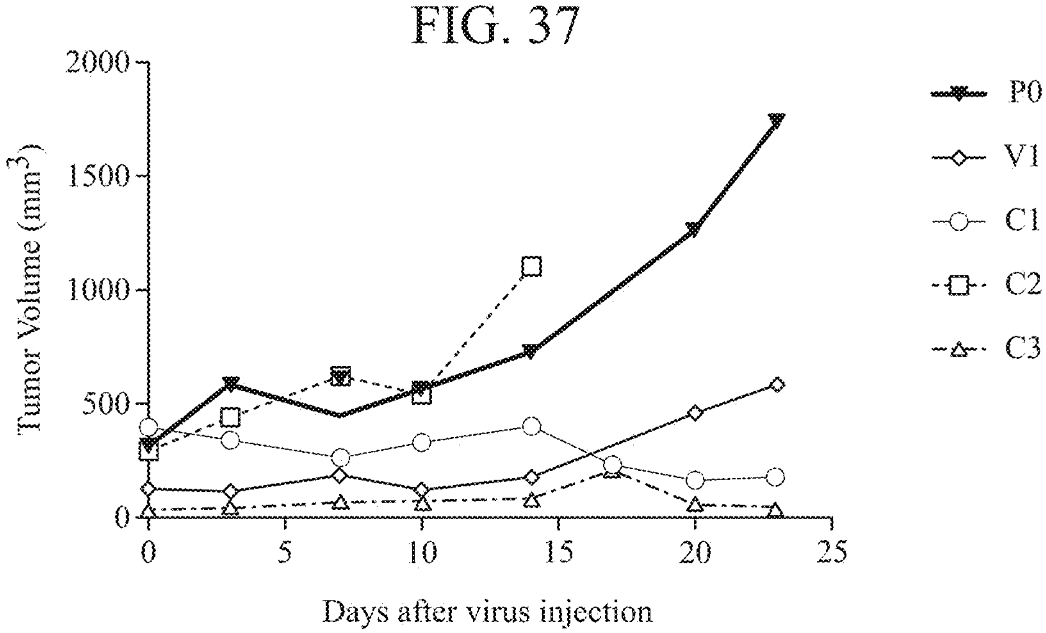
FIG. 37 are graphical representations of data showing volumes of tumors over days after PBS, MVAΔC7L-hFlt3L-TK(−)-mOX40L, or MVAΔC7L-hFlt3L-TK(−)-mOX40L plus anti-PD-L1 antibody treatments. (P0-PBS; V1-MVAΔC7L-hFlt3L-muOX40L; C1, C2,C3-MVAΔC7L-hFlt3L-muOX40L+anti-PD-L1).

The combination with IT delivery of MVAΔC7L-hFlt3L-TK(−)-mOX40L and systemic delivery of anti-PD-L1 had superior anti-tumor efficacy in spontaneous breast cancers. MMTV-PyMT females develop multiple palpable mammary tumors with mean latency of 92 days of age, which are commonly used as a spontaneous tumor model (FIG. 36). After the first tumor became palpable, MVAΔC7L-hFlt3L-TK(−)-mOX40LC7LhFl3LmOX40Lwas injected to tumors on the right flanks and anti-PD-L1 antibody was given intraperitoneally at 250 μg per mouse. Tumor sizes were measured twice a week. Tumors from 2 mice that received IT MVAΔC7L-hFlt3L-TK(−)-mOX40LC7LhFl3Lm-OX40Land IP anti-PD-L1 antibody treatments were harvested and processed to single cell suspensions for surface labeling with anti-CD45, CD3, CD8, CD4, CD103 and CD69 antibodies. The live tumor infiltrating T cells were analyzed by FACS. Tumor volumes of individual mice were measured (FIG. 37). The mouse treated with PBS developed multiple tumors and the tumors grew rapidly. Intratumoral injection of MVAΔC7L-hFlt3L-TK(−)-mOX40LC7LhFl3LmOX40Ldelayed tumor growth compared with PBS. The combination of IT MVAΔC7L-hFlt3L-TK(−)-mOX40L and IP anti-PD-L1 antibody are more effective in suppressing tumor occurrence and growth compared with MVAΔC7L-hFlt3L-TK(−)-mOX40L alone.

Figure 38:
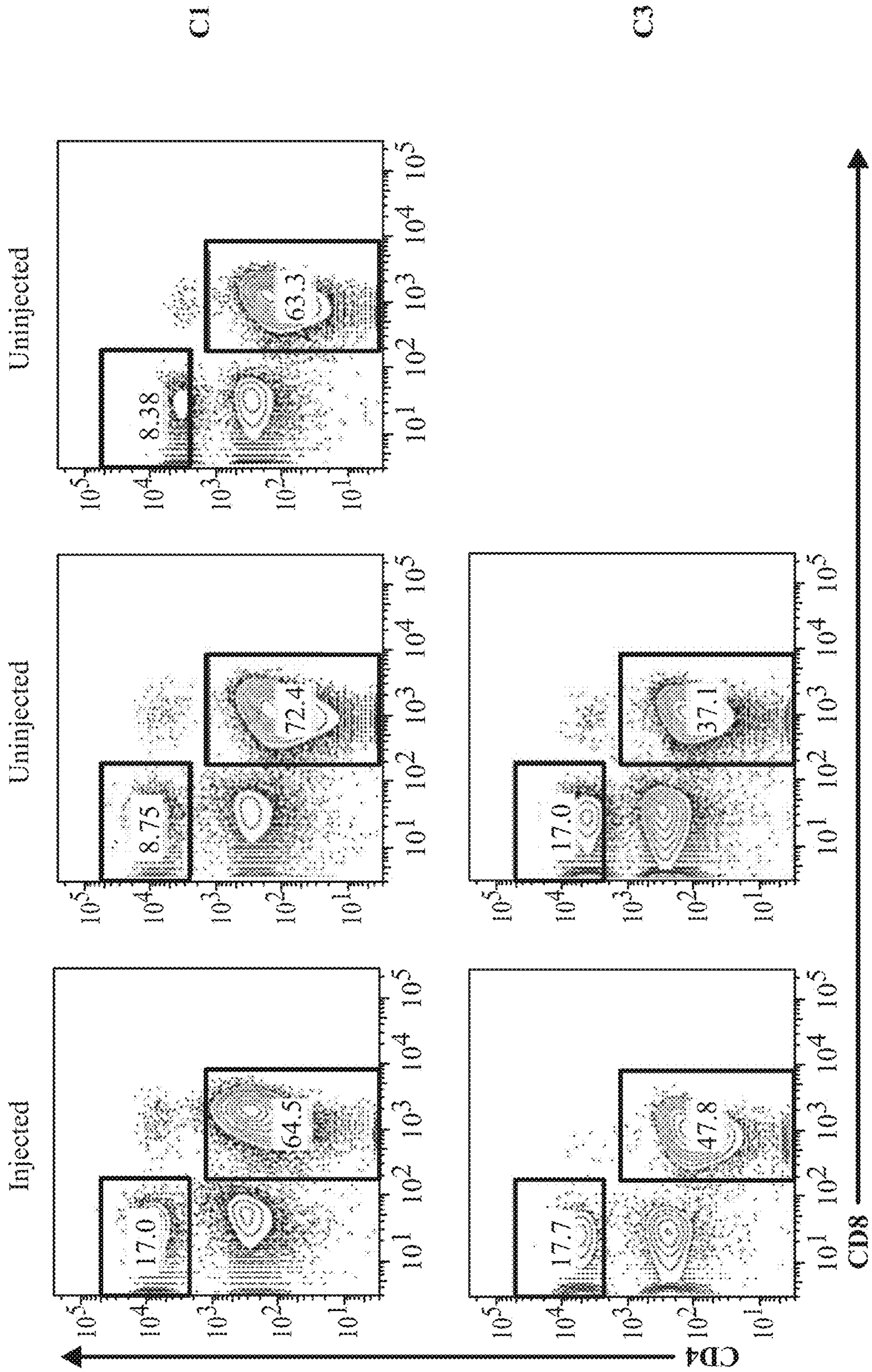
FIG. 38 shows representative dot plots of $CD8^+$ and $CD4^+$ T cells in injected and non-injected tumors after treatment with either PBS, MVAΔC7L-hFlt3L-TK(−)-muOX40L, or MVAΔC7L-hFlt3L-TK(−)-muOX40L plus anti-PD-L1 antibody.
Figure 39:
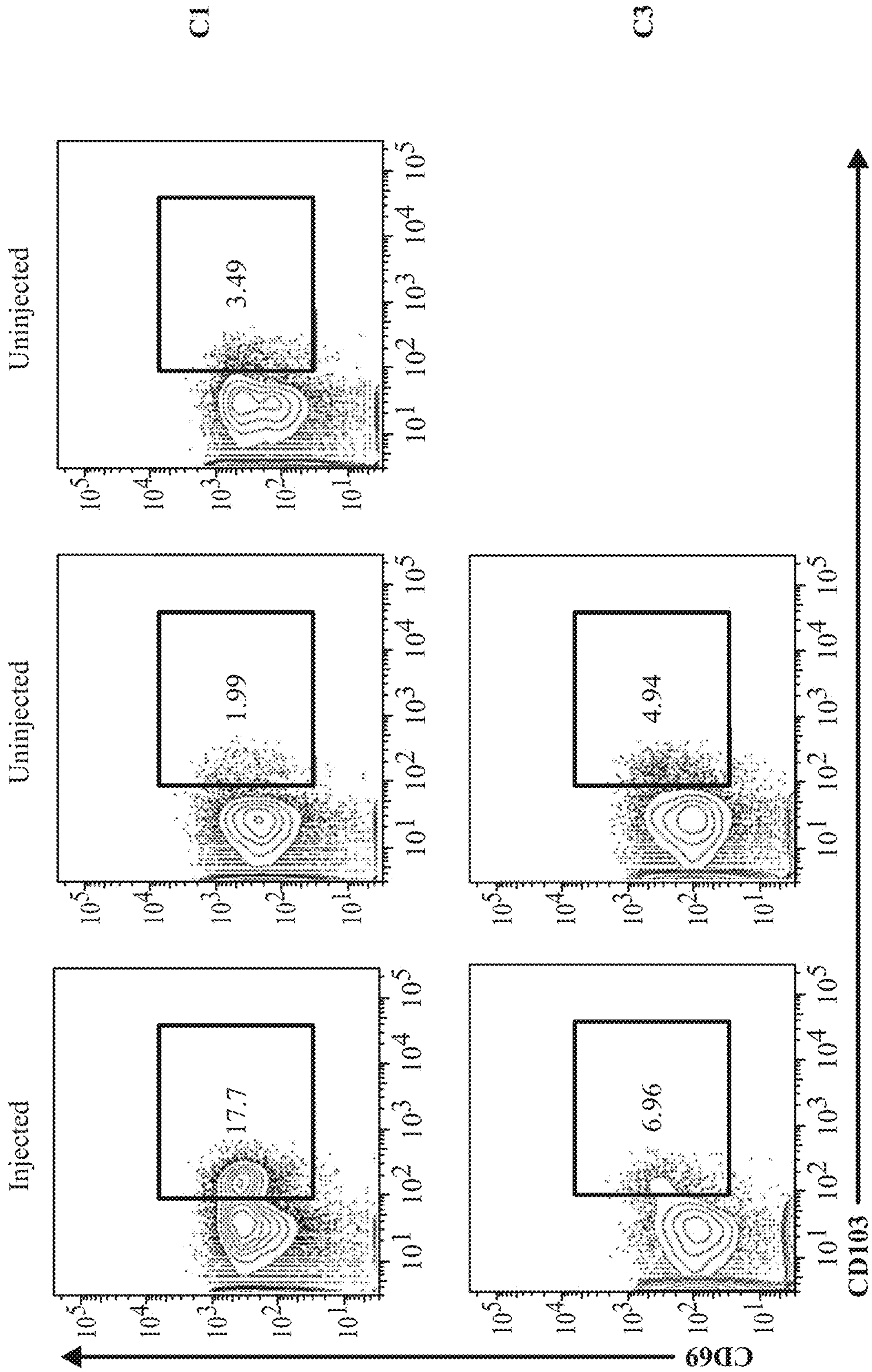
FIG. 39 shows representative dot plots of $CD8^+CD69^+$ $CD103^+$ T cells in injected and non-injected tumors after treatment with either PBS, MVAΔC7L-hFlt3L-TK(−)-muOX40L, or MVAΔC7L-hFlt3L-TK(−)-muOX40L plus anti-PD-L1 antibody.
Figure 40:
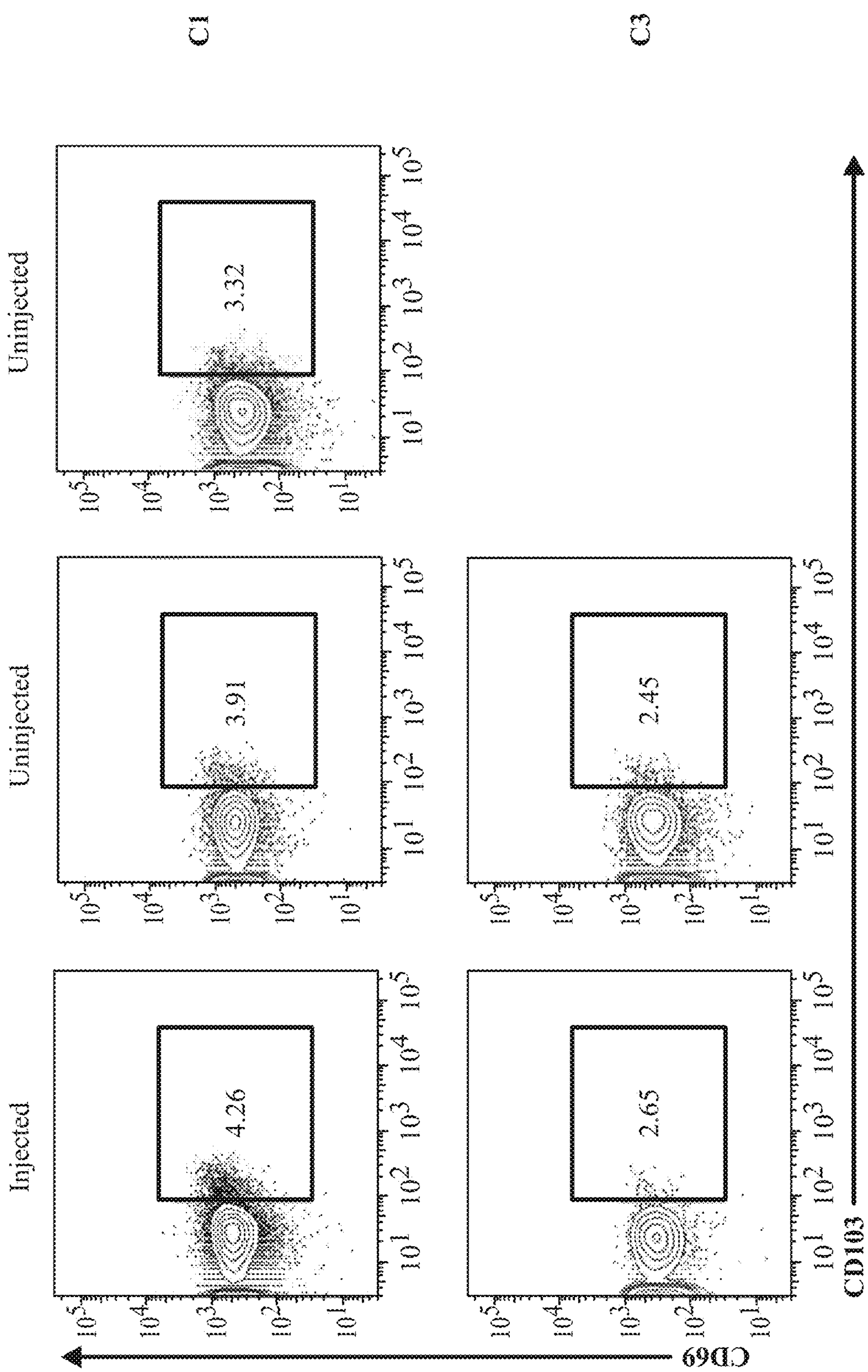
FIG. 40 shows representative dot plots of $CD4^-CD69^-$ $CD103^+$ T cells in injected and non-injected tumors after treatment with either PBS, MVAΔC7L-hFlt3L-TK(−)-muOX40L, or MVAΔC7L-hFlt3L-TK(−)-muOX40L plus anti-PD-L1 antibody.

FACS analyses of tumor infiltrating lymphocytes showed that T cells were abundant in tumor microenvironment in PyMT tumors (FIG. 38). IT MVAΔC7L-hFlt3L-TK(−)-mOX40L and IP anti-PD-L1 antibody treatment induced a higher percentage of $CD103^+CD69^+$ cell population of $CD8^+$ T cells (FIG. 39), which represents activated, memory-like $CD8^+$ T cells. IT MVAΔC7L-hFlt3L-TK(−)-mOX40L and IP anti-PD-L1 antibody treatment did not induce a higher percentage of $CD103^+CD69^+$ cell population of $CD4^+$ T cells (FIG. 40), demonstrating that the anti-tumor effect of the combination therapy in MMTV-PyMT tumor model mainly relied on $CD8^+$ T cell activation.

Example 50: Generation of B16-F10 stable cell lines over-expressing hFlt3L or mOX40L.

Figure 41A:
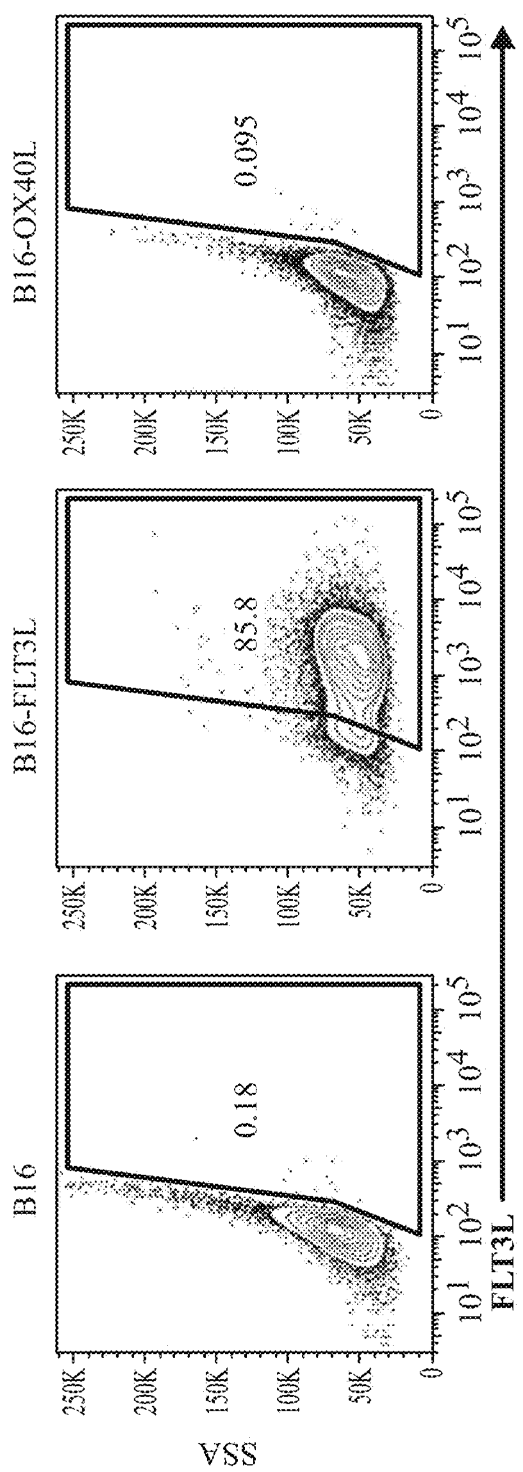
FIGS. 41A and 41B are representative FACS plots showing the expression of hFlt3L (FIG. 41A) or mOX40L (FIG. 41B) by B16-F10-hFlt3L or B16-F10-mOX40L stable cell lines.
Figure 41B:
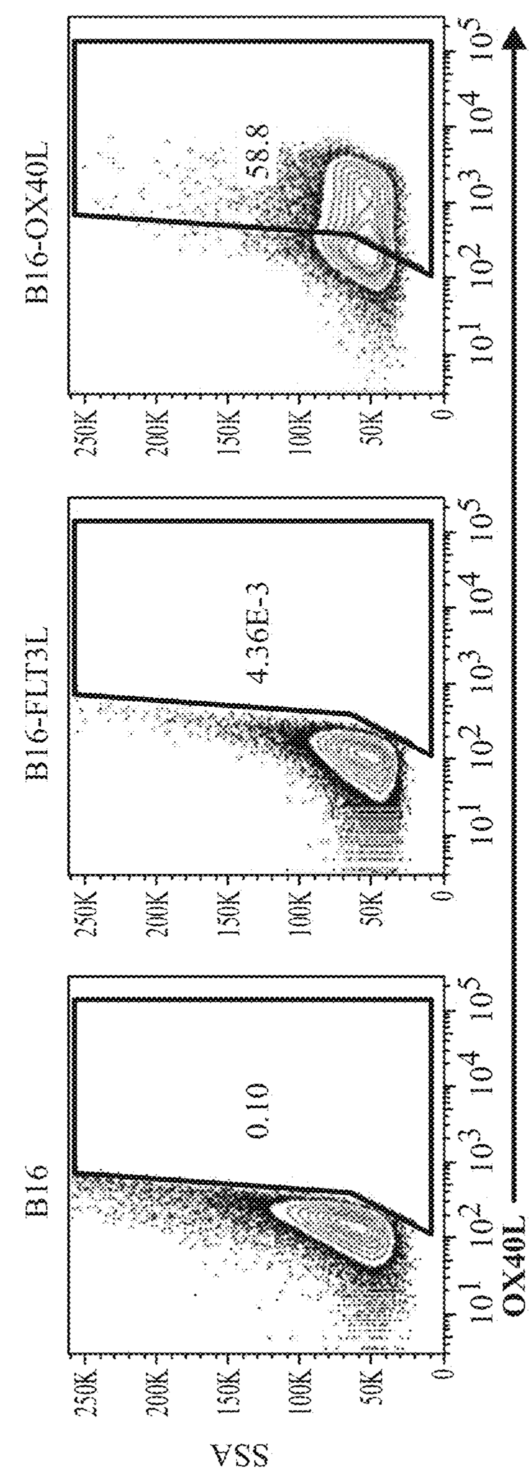

This example demonstrated the generation of B16-F10 stable cell line overexpressing either hFl3L or mOX40L. Briefly, B16-F10 cells were transfected with retrovirus expressing either hFl3L or mOX40L. After selection in 2 μg/ml puromycin for one week, cells were harvested and hFl3L (FIG. 41A) or mOX40L (FIG. 41B) expression at cellular surface were detected and confirmed by FACS.

Example 51: B16-F10 melanoma cells overexpressing hFlt3L are more responsive to intratumoral delivery of MVAΔC7L.

Figure 42:
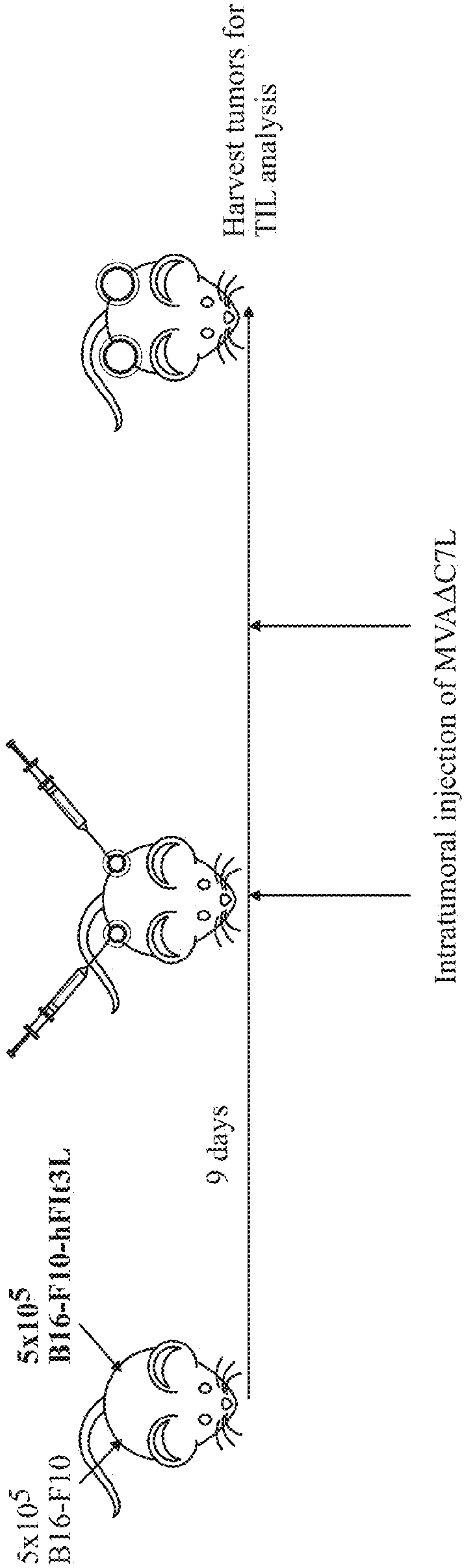
FIG. 42 is a scheme of tumor implantation and treatment for a B16-F10 bilateral tumor implantation model. Briefly, $5\times10^5$ B16-F10 melanoma cells were implanted intradermally to right flanks of C57B/6J mice and $5\times10^5$ B16-F10-hFlt3L melanoma cells were implanted intradermally to left flanks of C57B/6J mice. Nine days post tumor implantation, PBS or $4\times10^7$ pfu of MVAΔC7L were intratumorally injected twice weekly to the tumors on both flanks. Tumors were harvested 2 days post second injection and tumor infiltrating lymphocytes (TILs) were analyzed by FACS.
Figure 43A:
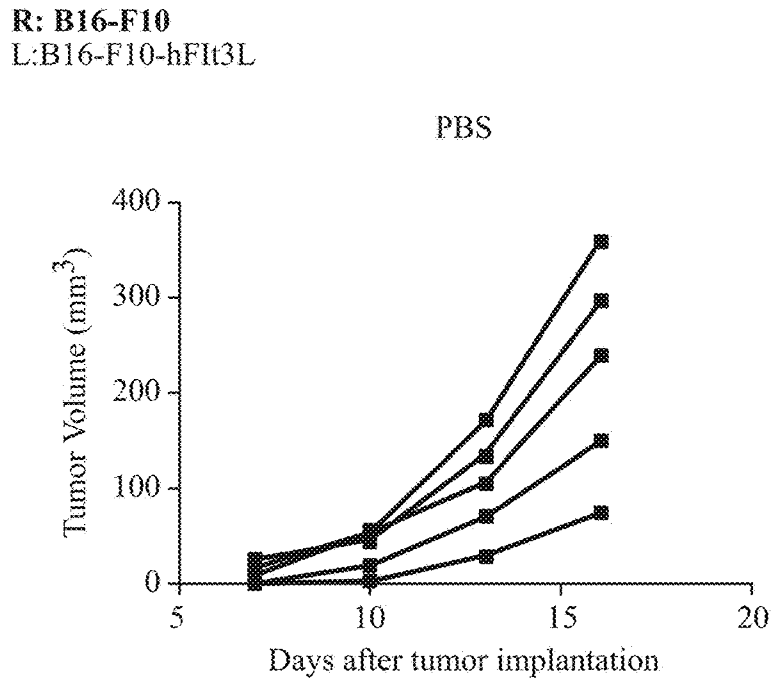
FIGS. 43A-43D are graphical representations of data showing volumes of tumors in either the right of left flanks of C57B/6J mice over days after PBS or MVAΔC7L treatments.
Figure 43B:
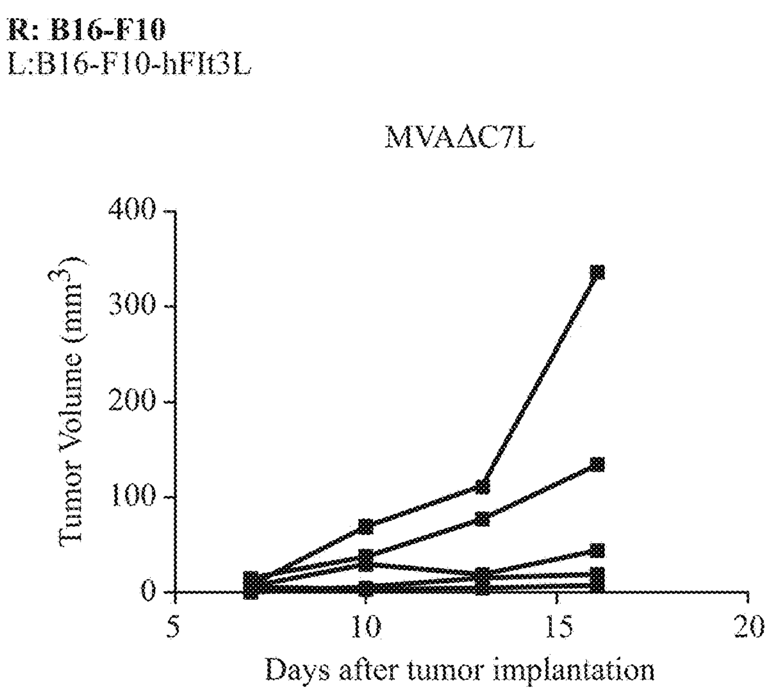
Figure 43C:
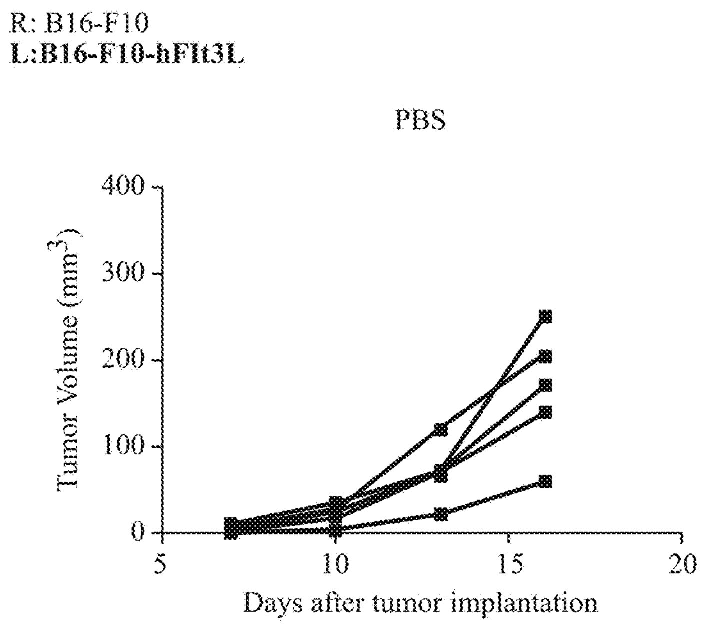
Figure 43D:
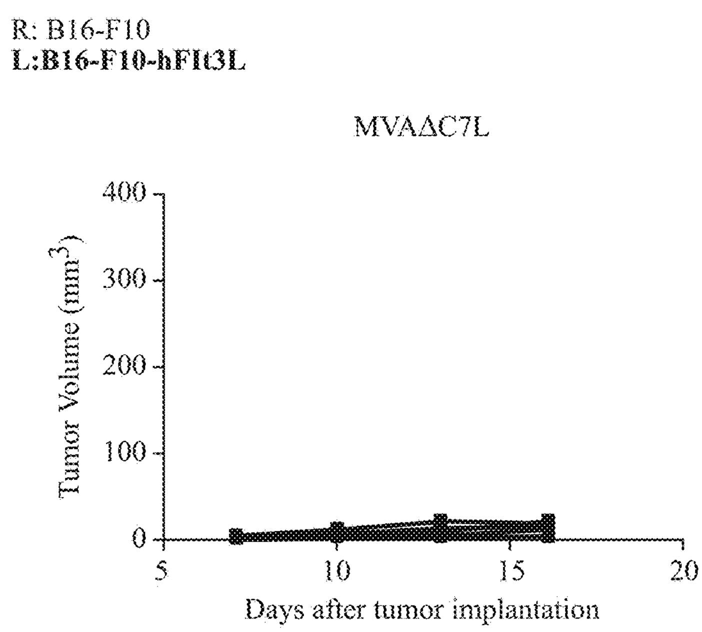
Figure 44A:
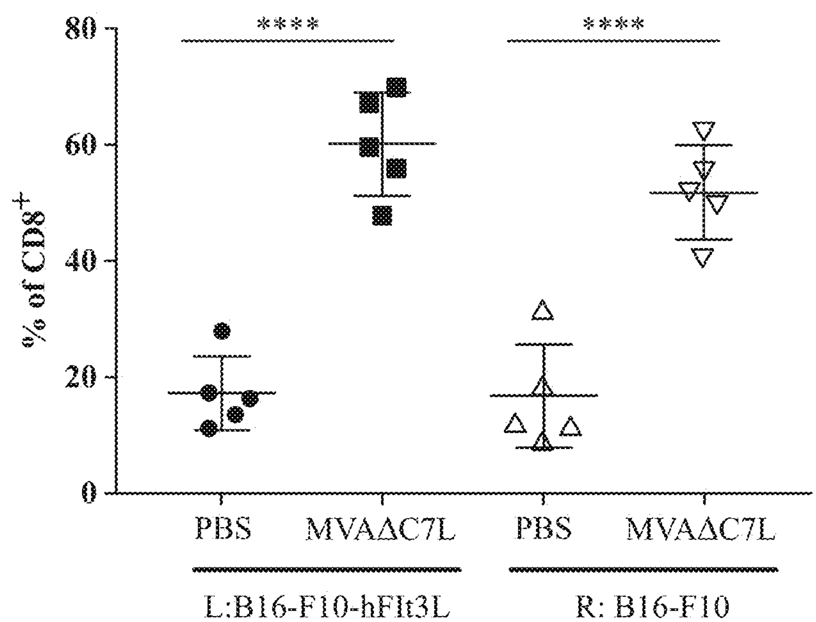
FIGS. 44A-44E are graphs of the percentage of tumor infiltrating $CD8^+$ (FIG. 44A), $CD8^+$GranzymeB$^+$ (FIG. 44B), $CD4^+$ (FIG. 44C), $CD4^+$GranzymeB$^+$ (FIG. 44D), and $CD4^+FoxP3^+$ (FIG. 44E) T cells after PBS or MVAΔC7L treatments. (n=5, *P<0.05; P<0.01; *P<0.001, ****P<0.0001; One-way ANOVA).
Figure 44B:
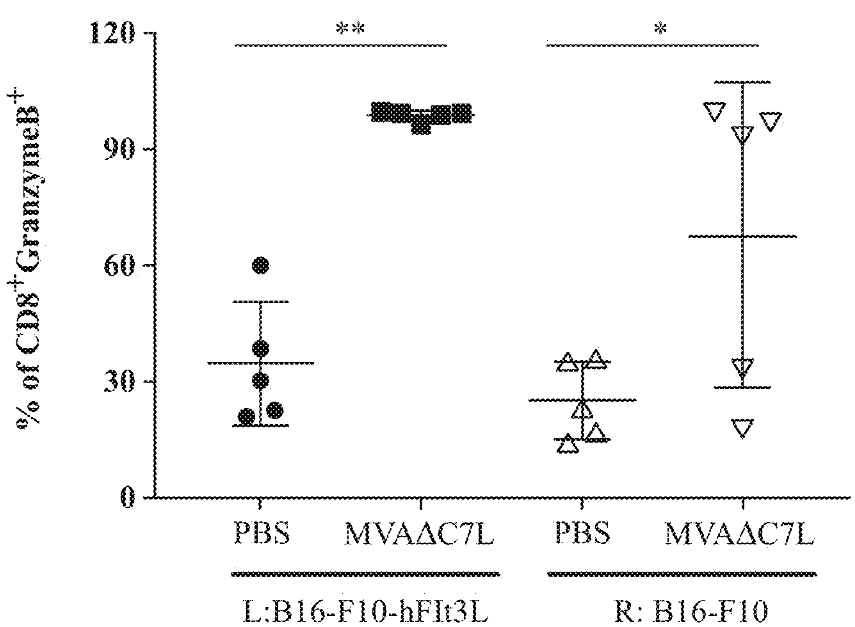
Figure 44C:
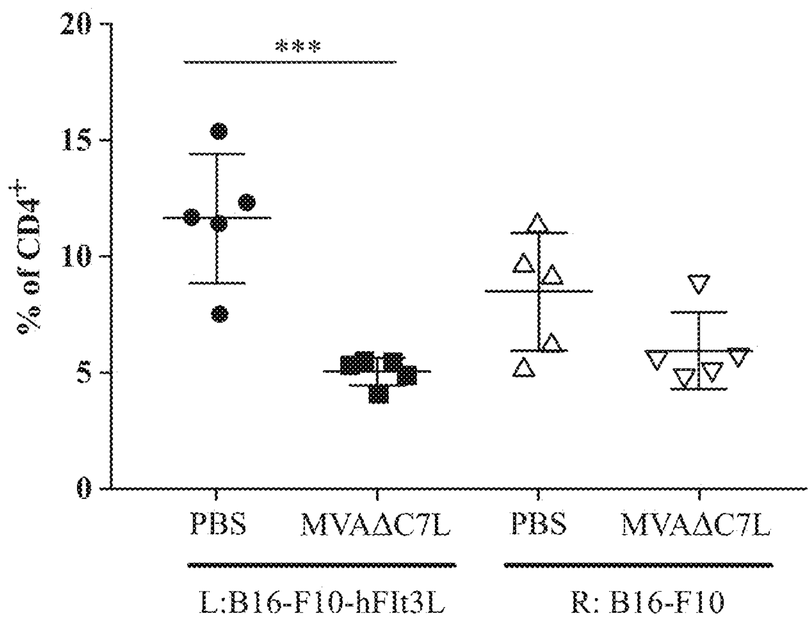
Figure 44D:
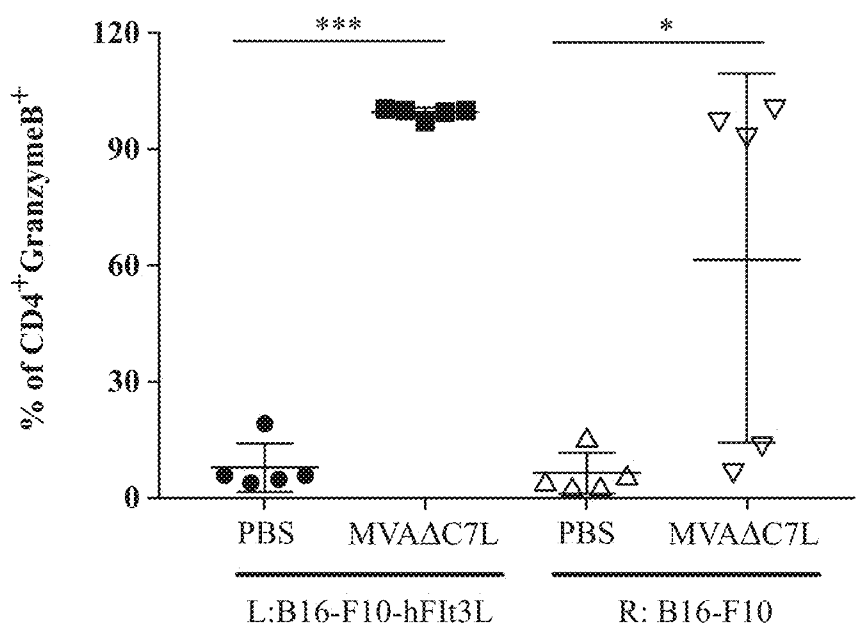
Figure 44E:
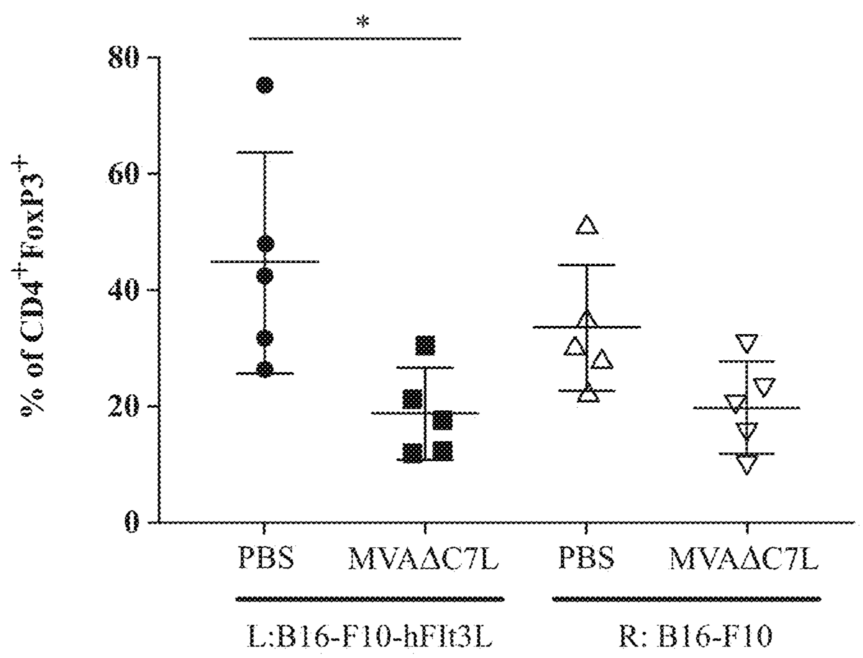
Figure 45A:
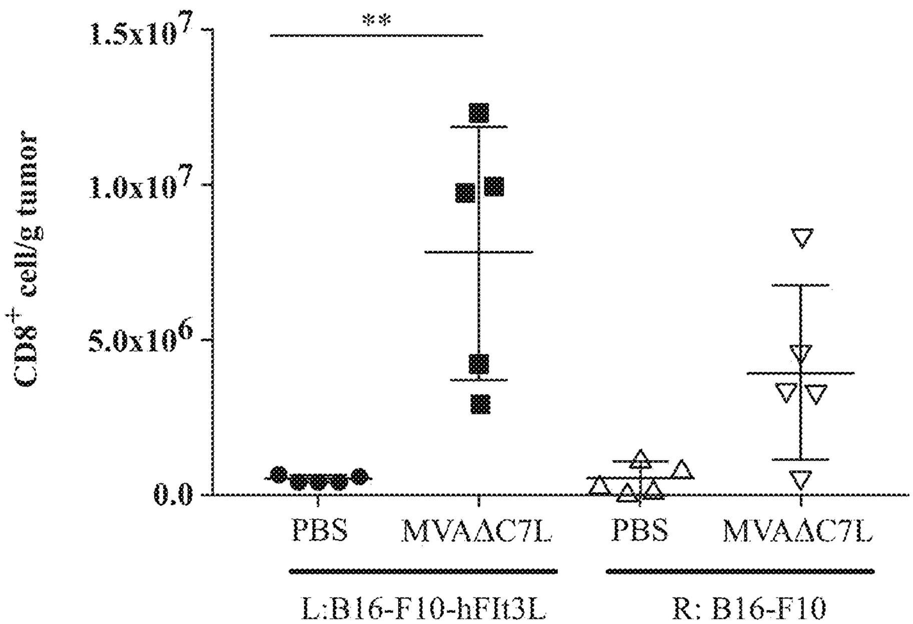
FIGS. 45A-45E are graphs of the absolute numbers of tumor infiltrating $CD8^+$ (FIG. 45A), $CD8^+$GranzymeB$^+$ (FIG. 45B), $CD4^+$ (FIG. 45C), $CD4^+$GranzymeB$^+$ (FIG. 45D), $CD4^+$FoxP3$^+$ (FIG. 45E) T cells per gram of tumors after PBS, MVAΔC7L treatments. (n=5, *P<0.05; P<0.01; *P<0.001, ****P<0.0001; One-way ANOVA).
Figure 45B:
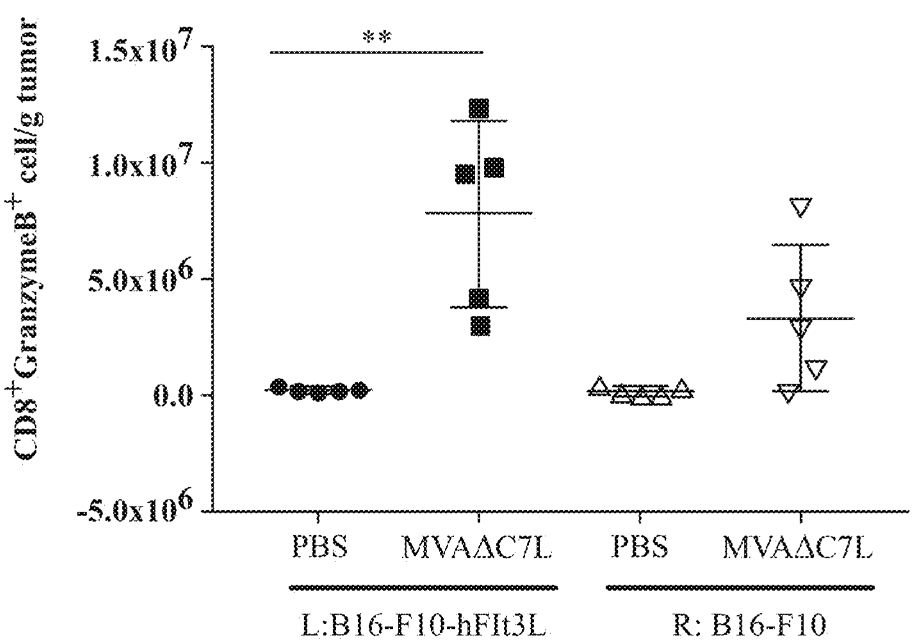
Figure 45C:
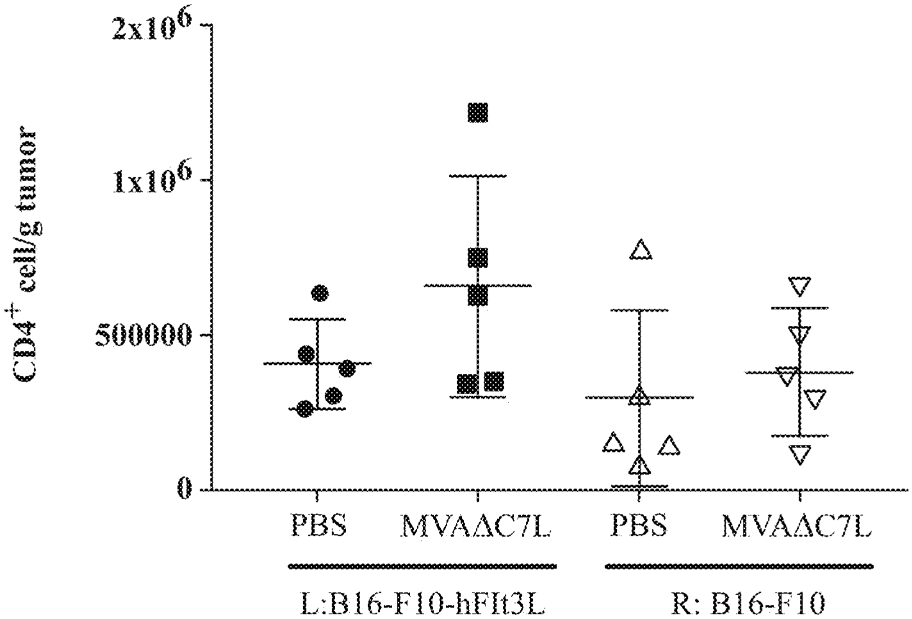
Figure 45D:
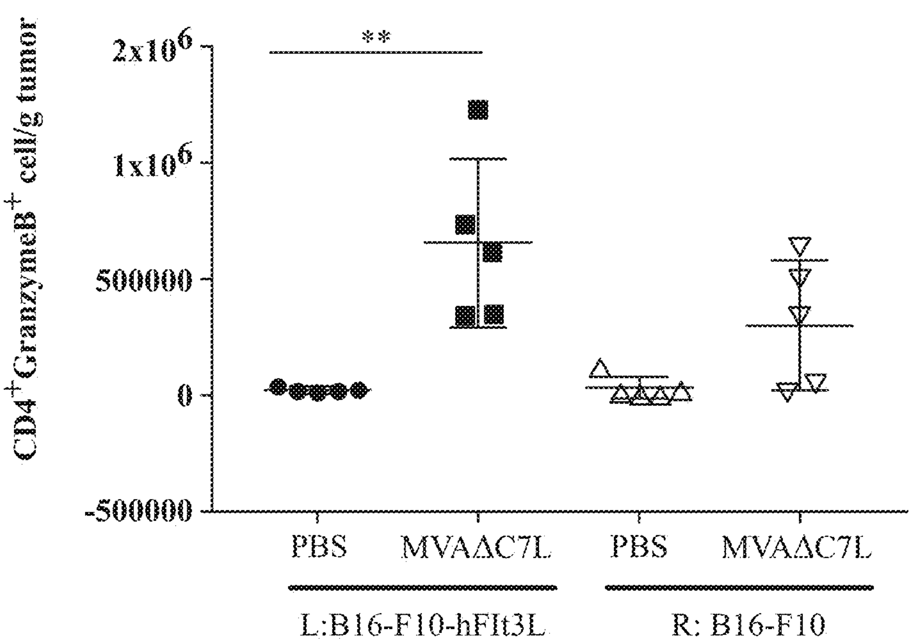
Figure 45E:
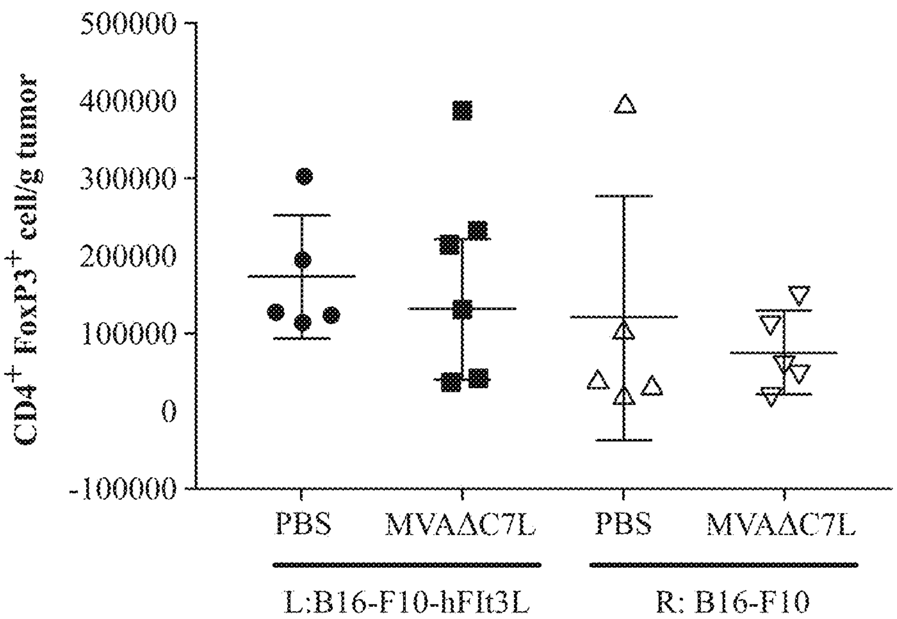

B16-F10 melanoma cells overexpressing hFl3L (B16-F10-hFl3L) are more responsive to intratumoral delivery of MVAΔC7L. Briefly, $5\times10^5$ B16-F10 melanoma cells were implanted intradermally to right flanks of C57B/6J mice and $5\times10^5$ B16-F10-hFl3L melanoma cells were implanted intradermally to left flanks of C57B/6J mice. Nine days post tumor implantation, PBS or $4\times10^7$ pfu of MVAΔC7L C7Lwere intratumorally injected twice weekly to the tumors on both flanks (FIG. 42). Tumor volumes from the right and left flanks of individual mice were measured (FIGS. 43A-43D). Tumors were harvested 2 days post second injection and tumor infiltrating lymphocytes were analyzed by FACS (FIGS. 44A-44E and 45A-45E). B16-F10 and B16-F10-hFl3L tumors treated with PBS had similar growth rate. In mice treated with MVAΔC7L, B16-F10-hFl3L tumor growth were significantly inhibited compared with B16-F10 tumors. Intratumoral injection of MVAΔC7L generated higher percentage of $CD8^+$ T cells (FIGS. 44A and 45A) and reduced $CD4^+$ T cells (FIGS. 44C and 45C) and $CD4^+FoxP3^+$ T cells (FIGS. 44E and 45E) in both B16-F10and B16-F10-hFl3L tumors compared with PBS group. IT MVAΔC7L C7Linduced more $CD8^+GranzymeB^+$ (FIGS. 44B and 45B) and $CD4^+GranzymeB^+$ T cells (FIGS. 44D and 45D) in B16-F10-hFl3L tumors. These results demonstrate that B16-F10 melanoma cells overexpressing hFl3L are more responsive to intratumoral delivery of MVAΔC7L C7Lwith enhanced T cell activation.

Example 52: B16-F10 melanoma cells overexpressing mOX40L are more responsive to intratumoral delivery of MVAΔC7L.

Figure 46:
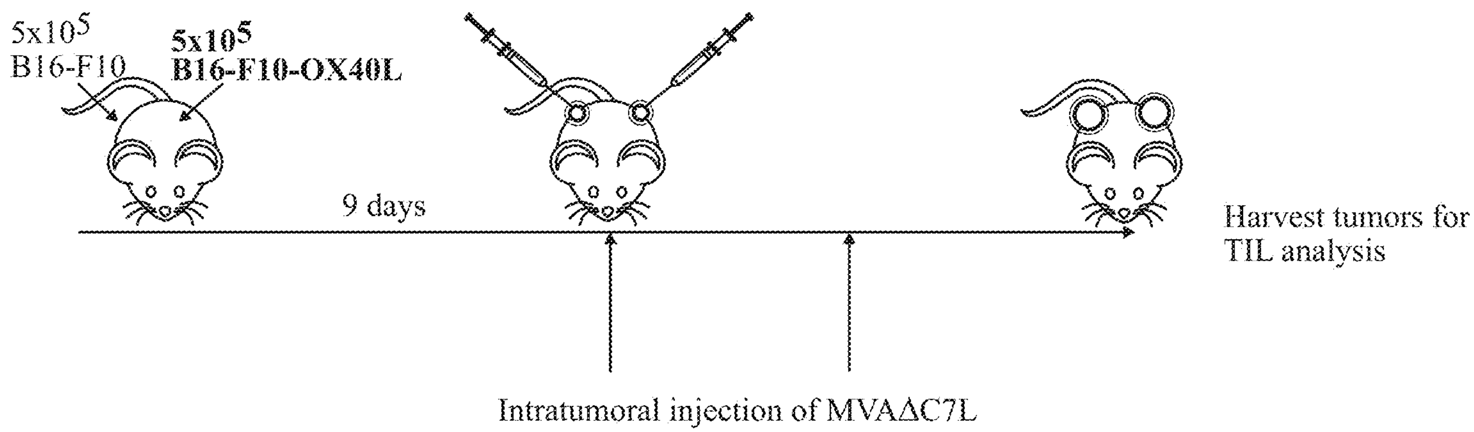
FIG. 46 is a scheme of tumor implantation and treatment for a B16-F10 bilateral tumor implantation model. Briefly, $5\times10^5$ B16-F10 melanoma cells were implanted intradermally to right flanks of C57B/6J mice and $5\times10^5$ B16-F10-OX40L melanoma cells were implanted intradermally to left flanks of C57B/6J mice. Nine days post tumor implantation, PBS or $4\times10^7$ pfu of MVAΔC7L were intratumorally injected twice weekly to the tumors on both flanks. Tumors were harvested 2 days post second injection and tumor infiltrating lymphocytes (TILs) were analyzed by FACS.
Figure 47A:
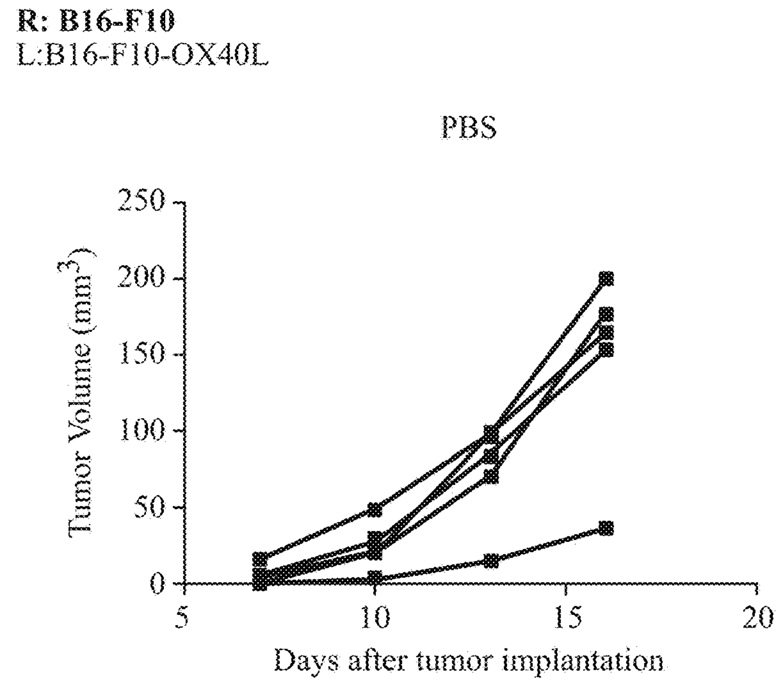
FIGS. 47A-47D are graphical representations of data showing volumes of tumors in either the right of left flanks of C57B/6J mice over days after PBS or MVAΔC7L treatments.
Figure 47B:
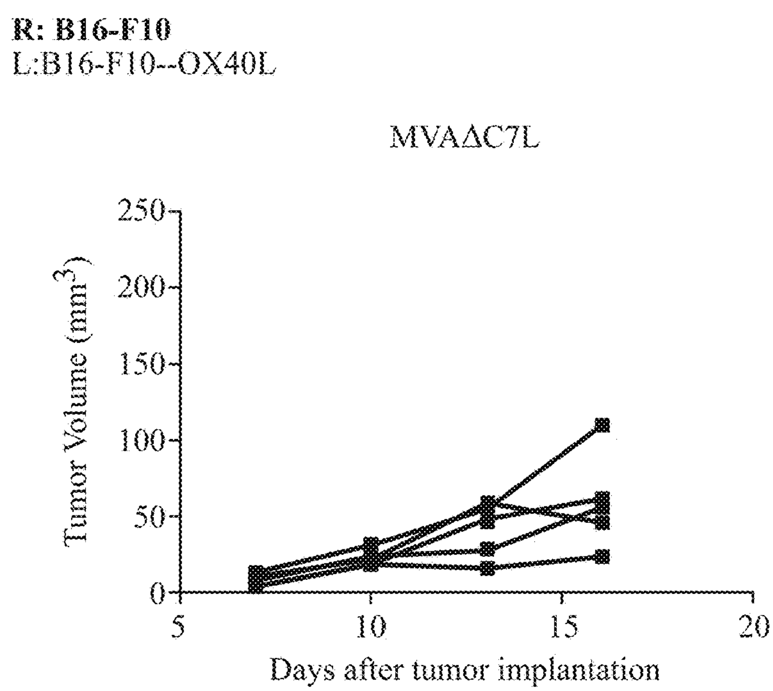
Figure 47C:
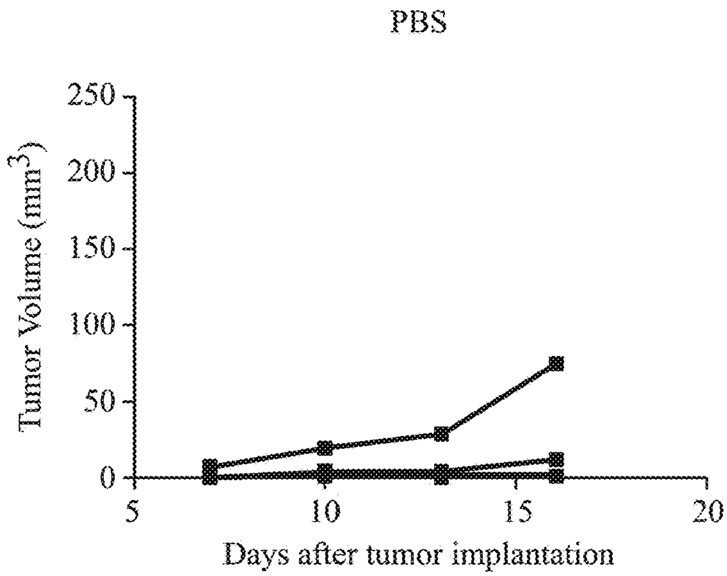
Figure 47D:
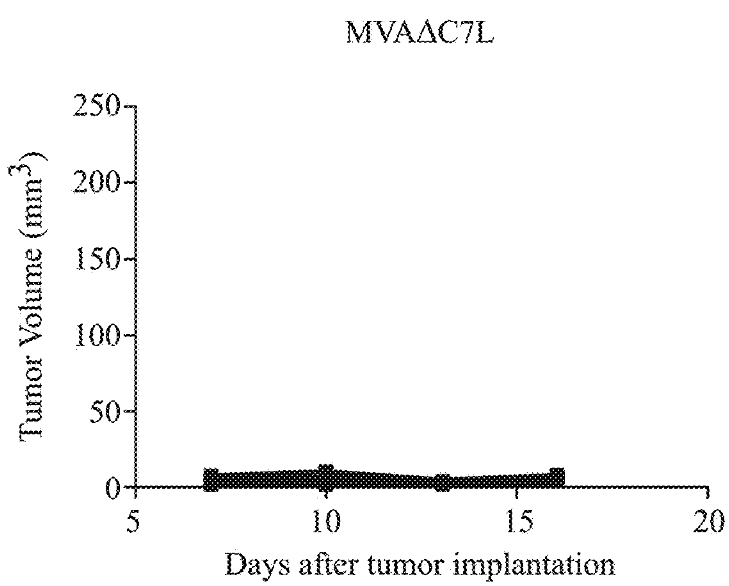
Figure 48A:
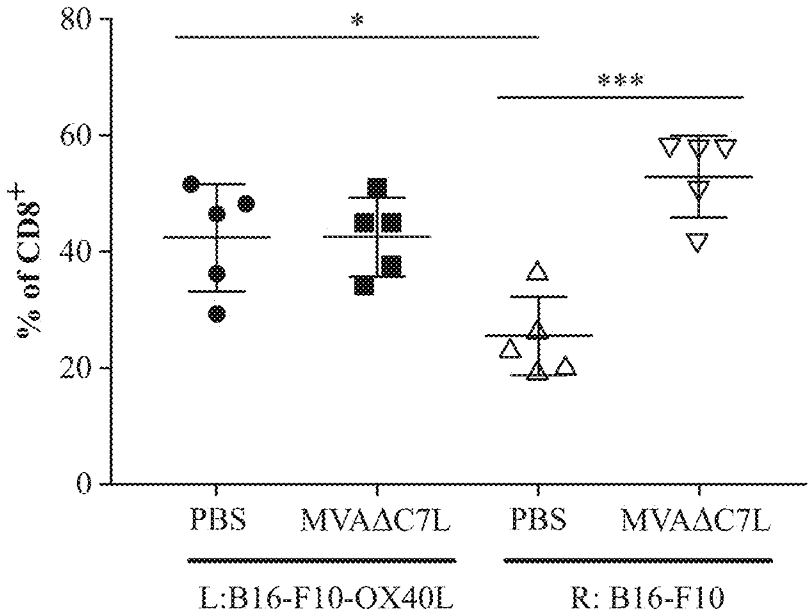
FIGS. 48A-48E are graphs of the percentage of tumor infiltrating $CD8^+$ (FIG. 48A), $CD8^+$GranzymeB$^+$ (FIG. 48B), $CD4^+$ (FIG. 48C), $CD4^+$GranzymeB$^+$ (FIG. 48D), $CD4^+$FoxP3$^+$ (FIG. 48E) T cells after PBS, MVAΔC7L C7Ltreatments. (n=5, *P<0.05; P<0.01; *P<0.001, ****P<0.0001; One-way ANOVA).
Figure 48B:
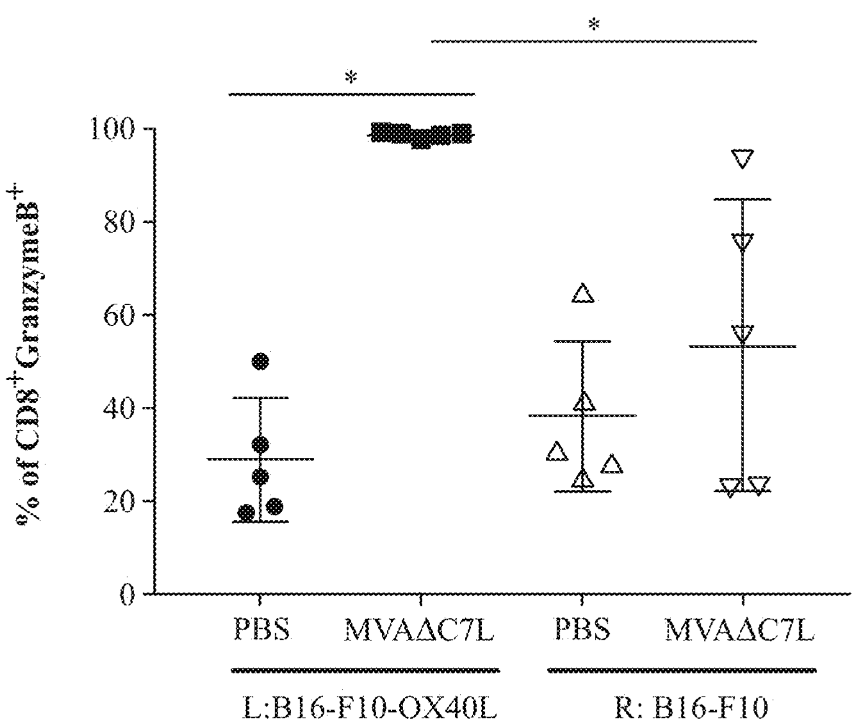
Figure 48C:
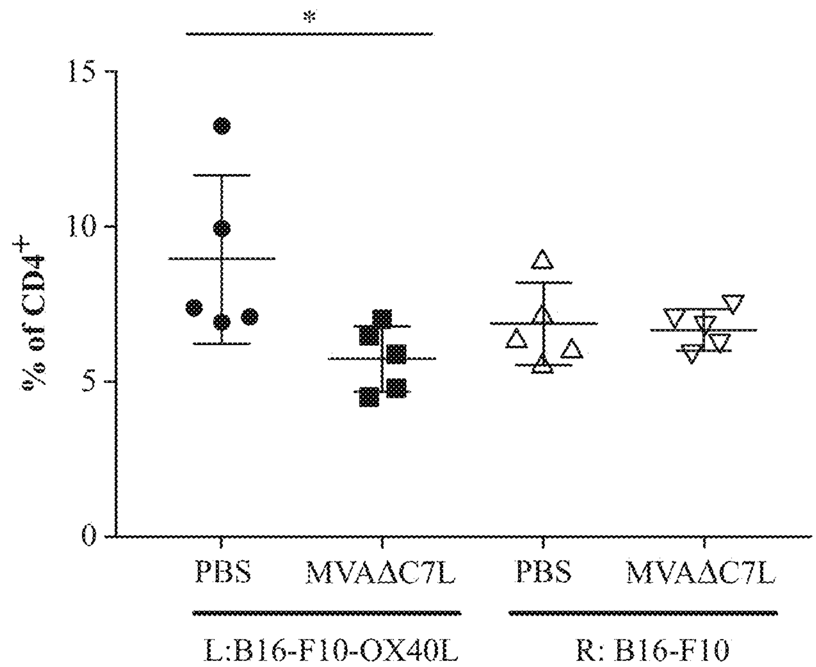
Figure 48D:
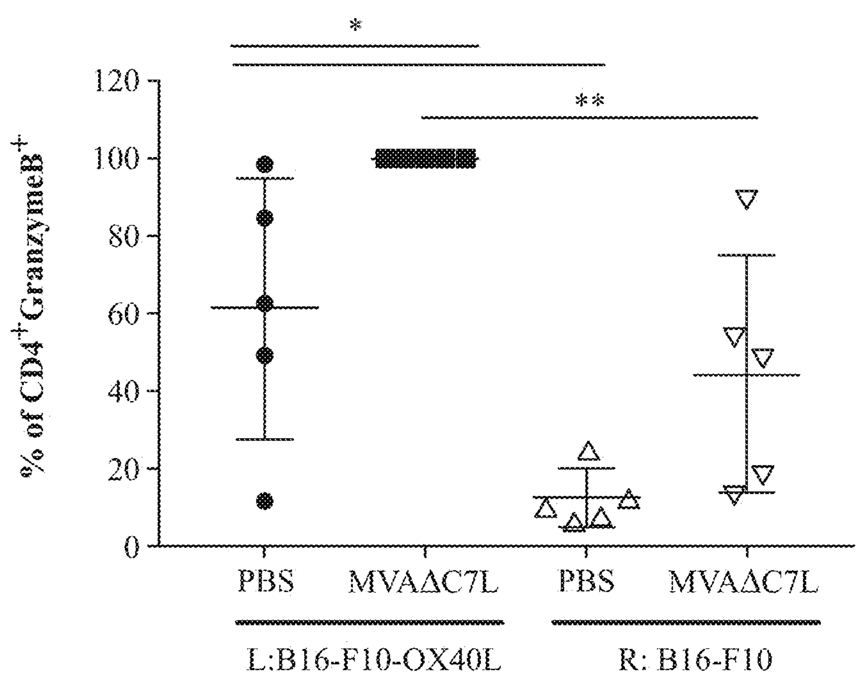
Figure 48E:
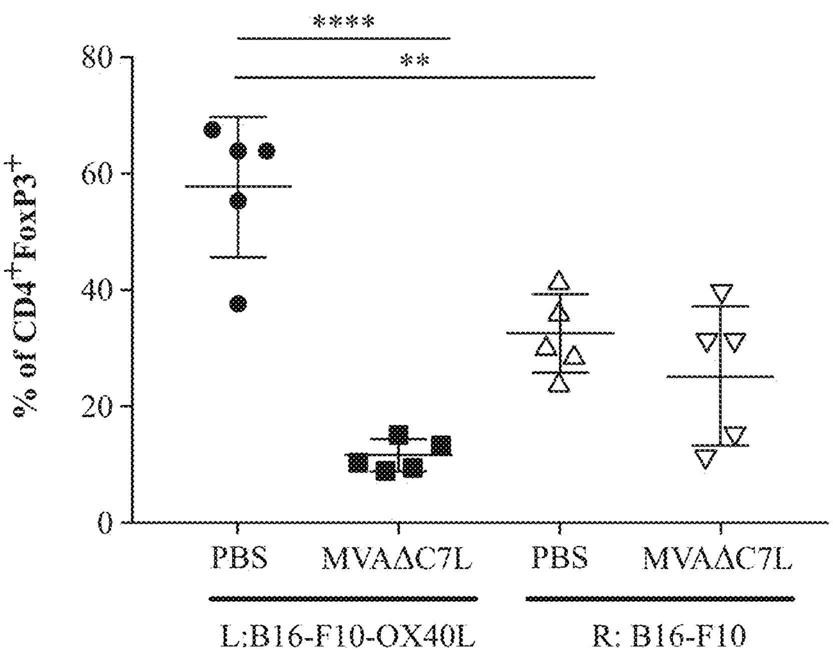
Figure 49A:
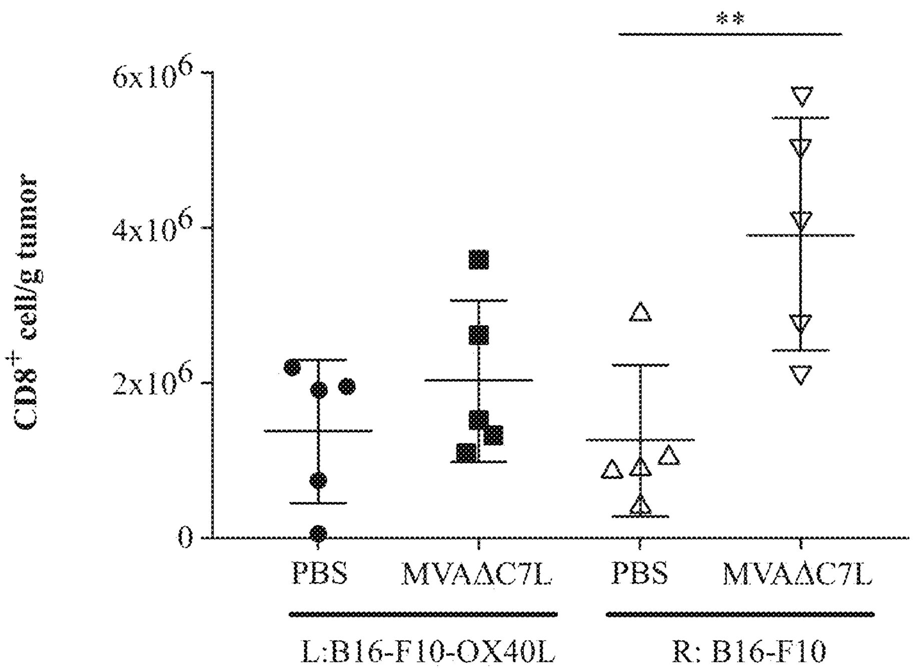
FIGS. 49A-49E are graphs of the absolute numbers of tumor infiltrating $CD8^+$ (FIG. 49A), $CD8^+$GranzymeB$^+$ (FIG. 49B), $CD4^+$ (FIG. 49C), $CD4^{30}$ GranzymeB$^+$ (FIG. 49D), $CD4^+$FoxP3$^+$ (FIG. 49E) T cells per gram of tumors after PBS, MVAΔC7L C7Ltreatments. (n=5, *P<0.05; P<0.01; *P<0.001, ****P<0.0001; One-way ANOVA).
Figure 49B:
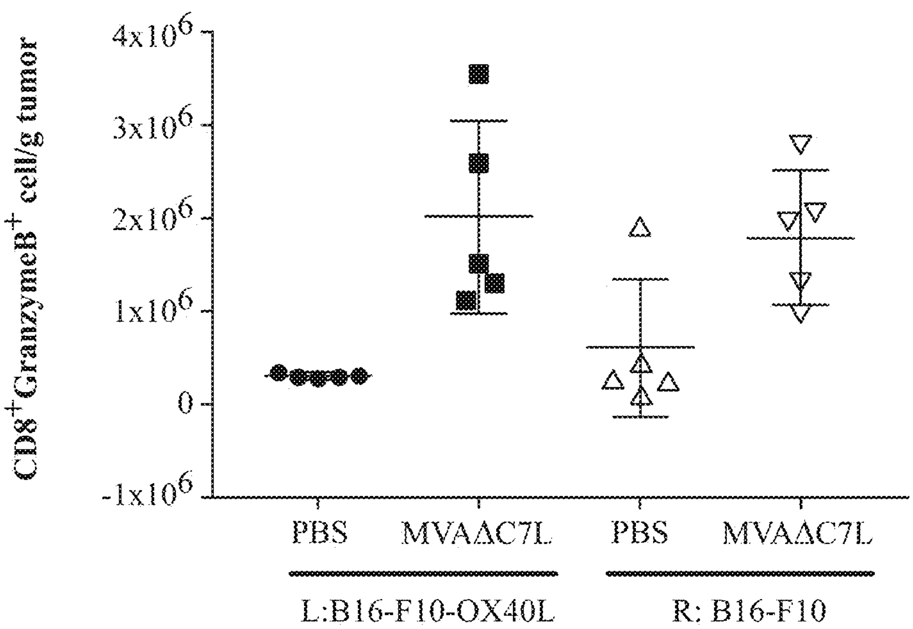
Figure 49C:
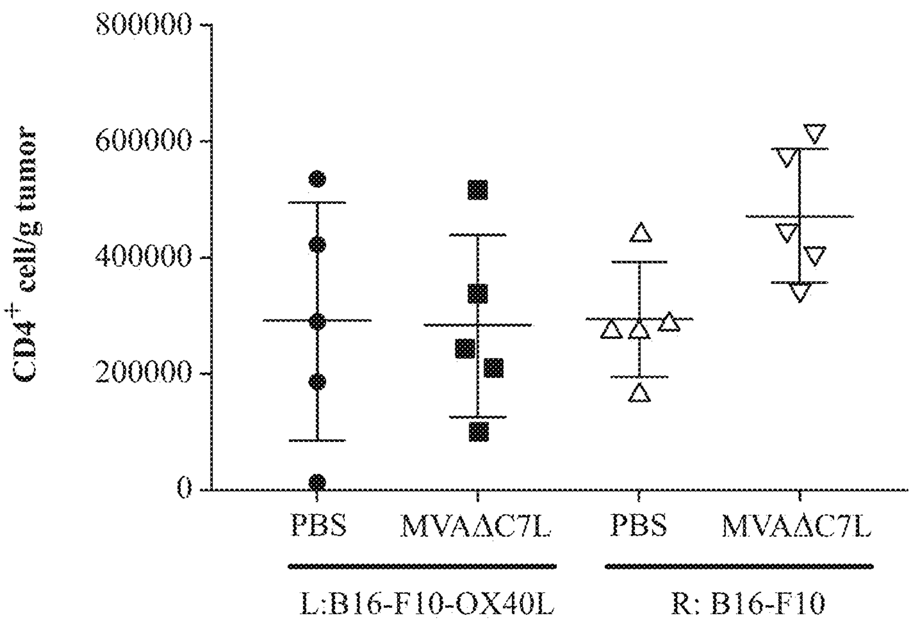
Figure 49D:
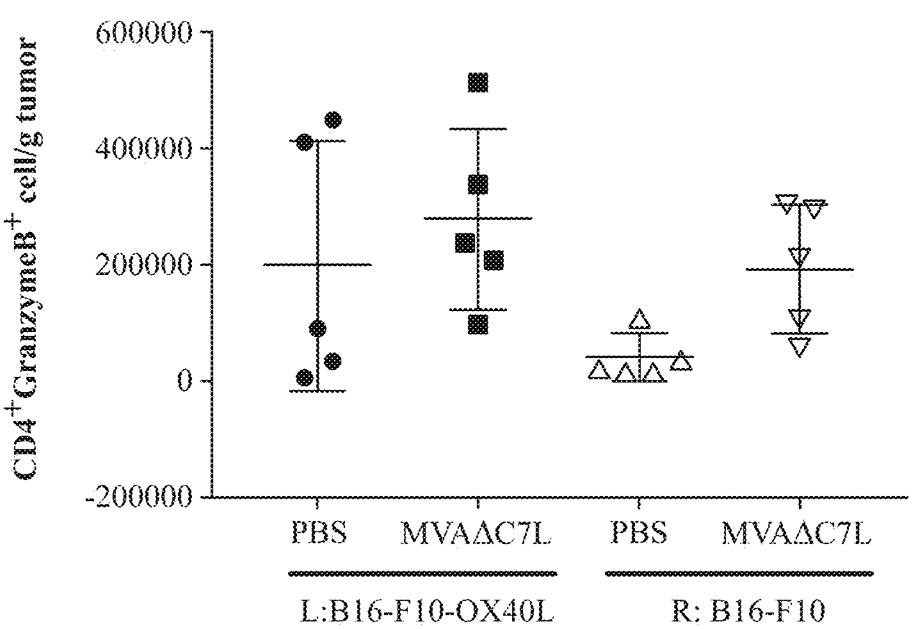
Figure 49E:
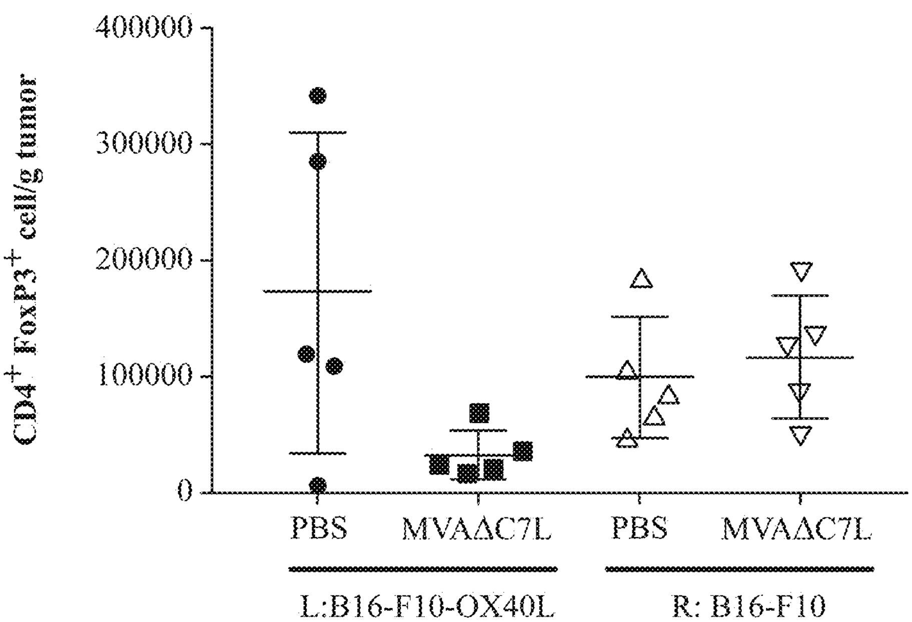

B16-F10 melanoma cells overexpressing mOX40L (B16-F10-OX40L) are more responsive to intratumoral delivery of MVAΔC7L. Briefly, $5\times10^5$ B16-F10 melanoma cells were implanted intradermally to right flanks of C57B/6J mice and $5\times10^5$ B16-F10-OX40L melanoma cells were implanted intradermally to left flanks of C57B/6J mice. Nine days post tumor implantation, PBS or $4\times10^7$ pfu of MVAΔC7L C7Lwere intratumorally injected twice weekly to the tumors on both flanks (FIG. 46). Tumor volumes from the right and left flanks of individual mice were measured twice weekly (FIGS. 47A-47D). Tumors were harvested 2 days post second injection and tumor infiltrating lymphocytes were analyzed by FACS (FIGS. 48A-48E and 49A-49E). B16-F10-OX40L tumors grew slower than B16-F10 tumors even in PBS treated group (FIGS. 47A and 47C). In mice treated with MVAΔC7L intratumorally, B16-F10 tumor growth was delayed (FIG. 47B) and B16-F10-OX40L tumor growth was significantly suppressed (FIG. 47D). Intratumoral injection of MVAΔC7L generated more activated $CD8^+$ (FIG. 48A and 49A) and $CD4^+$ T cells (FIG. 48C and 49C) in B16-F10 tumors compared with PBS treated group. Remarkably, 99%~100% $CD8^+$ and $CD4^+$ T cells infiltrating B16-F10-OX40L tumors were $GranzymeB^+$ (FIGS. 48B and 48D; 49B and 49D). More $CD4^+FoxP3^+$ T cells were infiltrating B16-F10-OX40L tumors than B16-F10 tumors but IT MVAΔC7L C7Ldepleted these cells efficiently from an average of 60% to 15% out of total $CD4^+$ T cells (FIGS. 48E and 49E). These results demonstrate that B16-F10 melanoma cells overexpressing OX40L are more responsive to intratumoral delivery of MVAΔC7L. OX40L plays an important role in activation of $CD8^+$ and $CD4^+$ T cell. IT MVAΔC7L C7Lis able to deplete $CD4^+FoxP3^+$ T cells in tumor microenvironment.

Example 53: FTY720 treatment enhances the anti-tumor efficacy of IT MVAΔC7L-hFlt3L-TK(−)-mOX40L with delayed tumor growth and prolonged survival in B16-F10 melanoma unilateral implantation model.

Figure 50A:
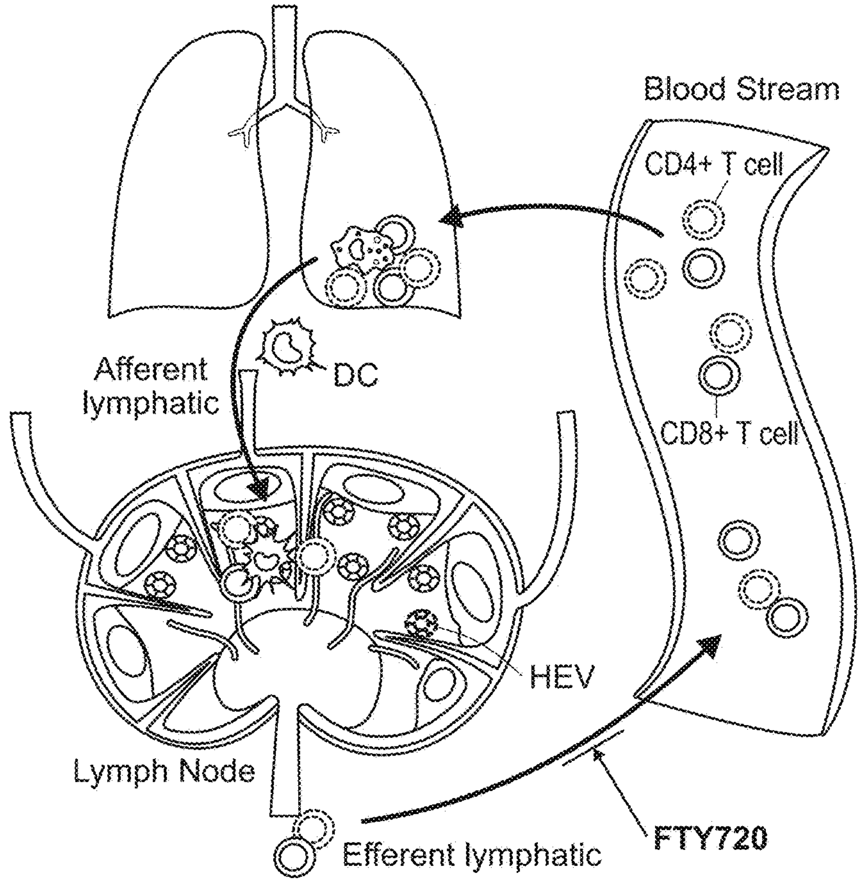
FIGS. 50A and 50B show the mechanism of action of FTY720 and its chemical structure.
Figure 50B:
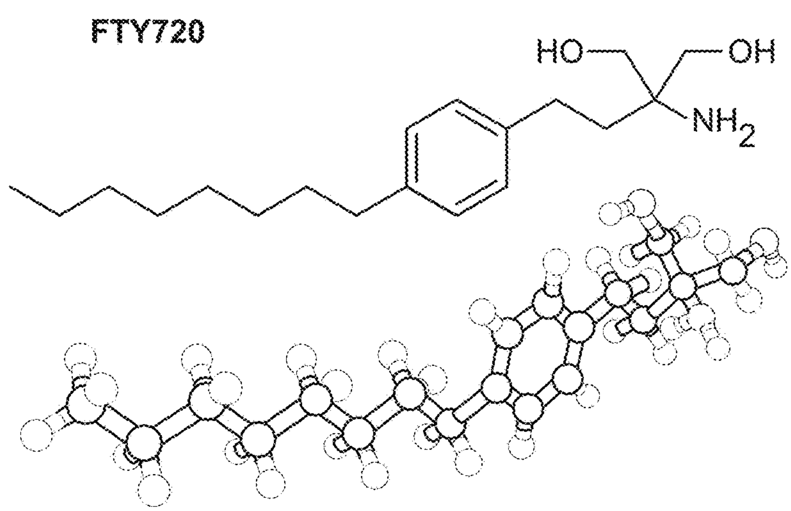
Figure 51:
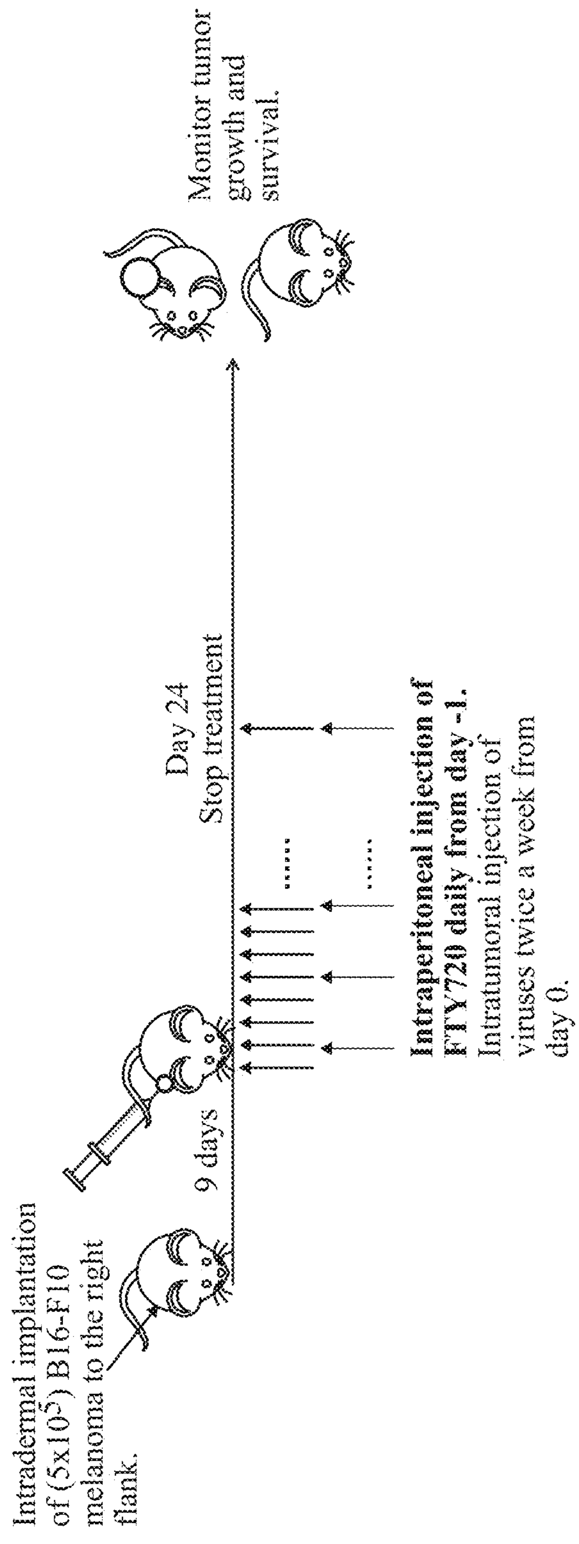
FIG. 51 is a scheme of tumor implantation and treatment for a B16-F10 unilateral tumor implantation model. Briefly, $5\times10^5$ B16-F10 melanoma cells were implanted intradermally to right flanks of C57B/6J mice. Nine days post tumor implantation, PBS or $4\times10^7$ pfu of MVAΔC7L-hFlt3L-TK(−)-muOX40L were intratumorally injected twice. FTY720 at 25 μg per mouse was given intraperitoneally daily during the treatment, starting 1 day prior to the first MVAΔC7L-hFlt3L-TK(−)-muOX40L injection. The tumor sizes were measured and the survival of mice was monitored.
Figure 52A:
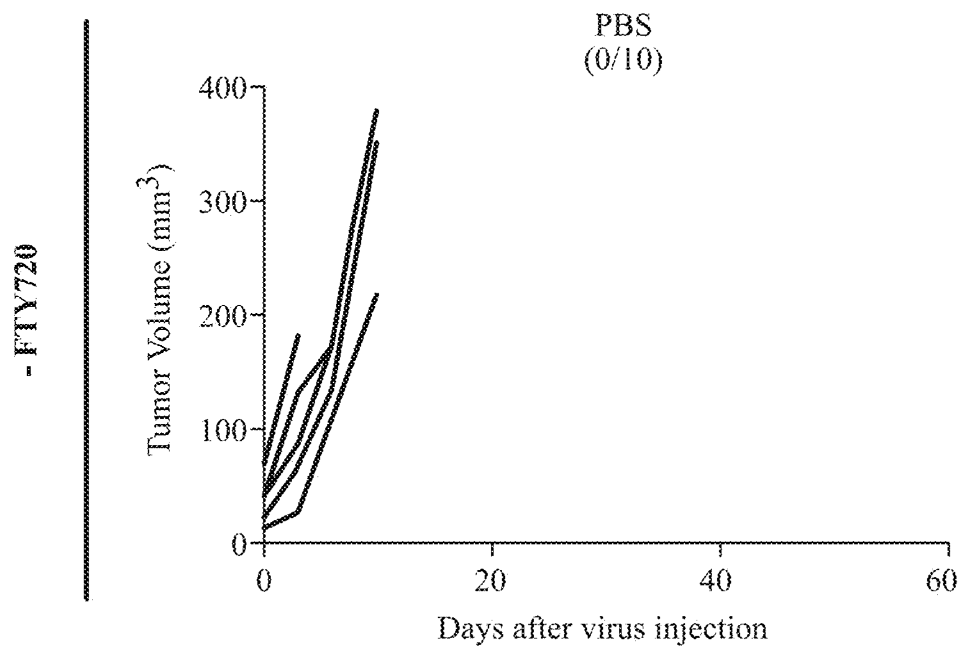
FIGS. 52A-52D are graphical representations of data showing volumes of tumors in C57B/6J mice over days after PBS or MVAΔC7L C7Ltreatments with or without FTY720 treatment.
Figure 52B:
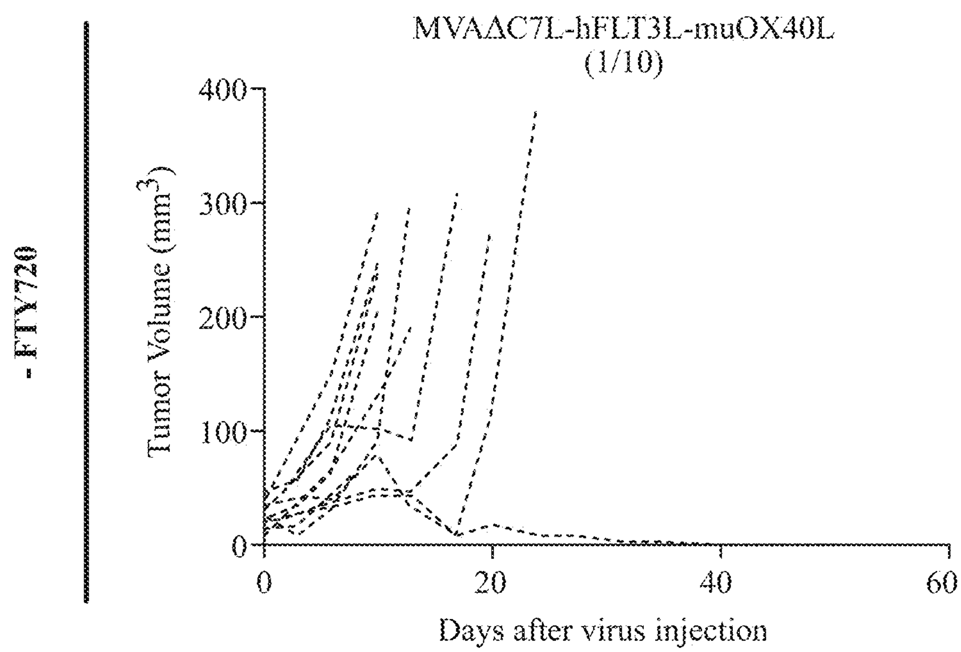
Figure 52C:
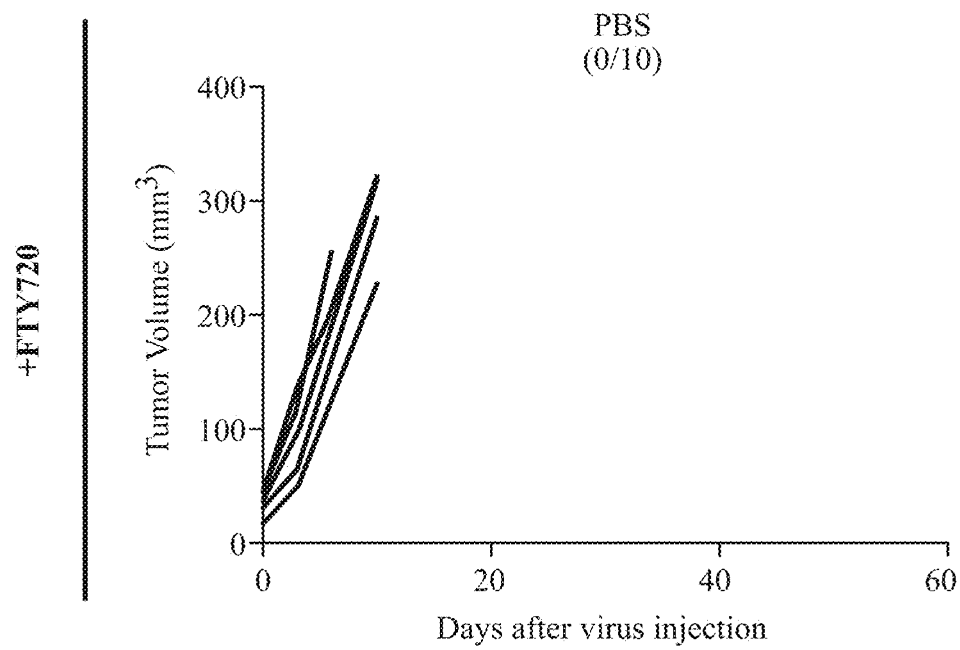
Figure 52D:
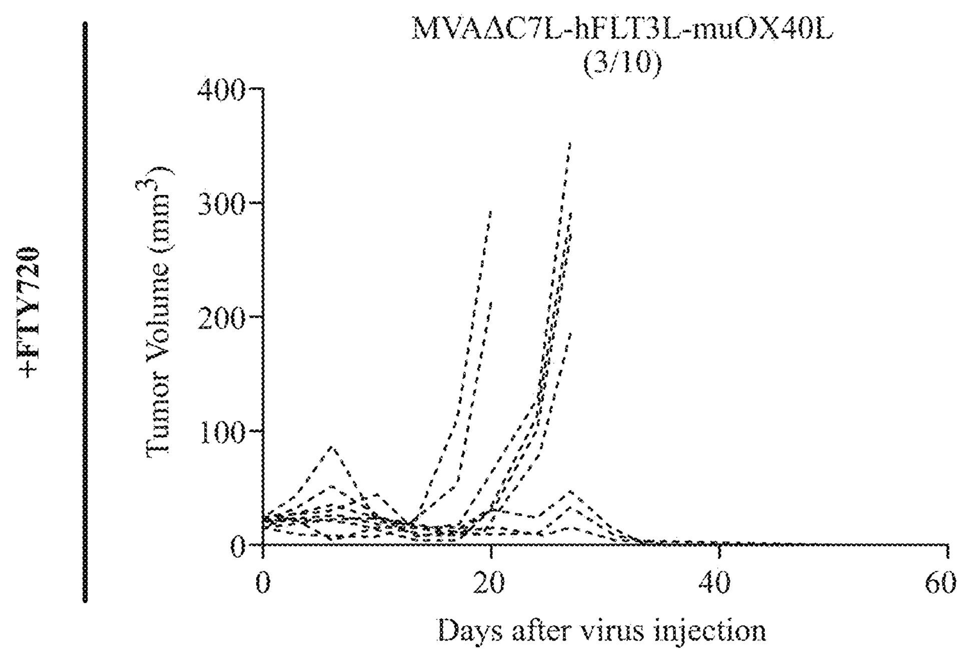
Figure 53A:
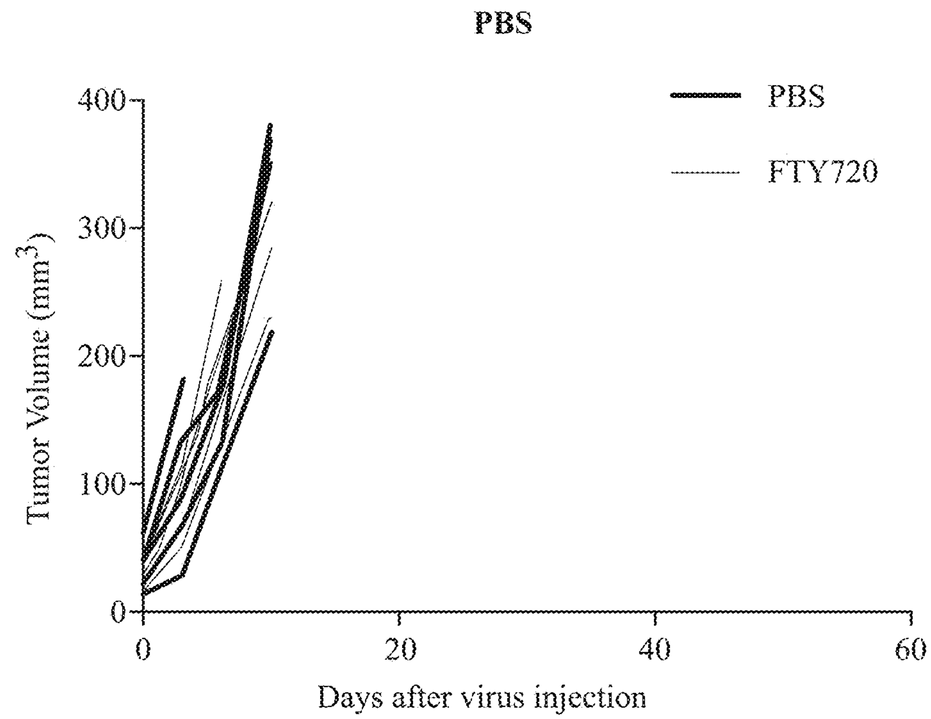
FIGS. 53A and 53B are graphical representations of data showing volumes of tumors in C57B/6J mice over days after PBS or MVAΔC7L C7Ltreatments with or without FTY720 treatment.
Figure 53B:
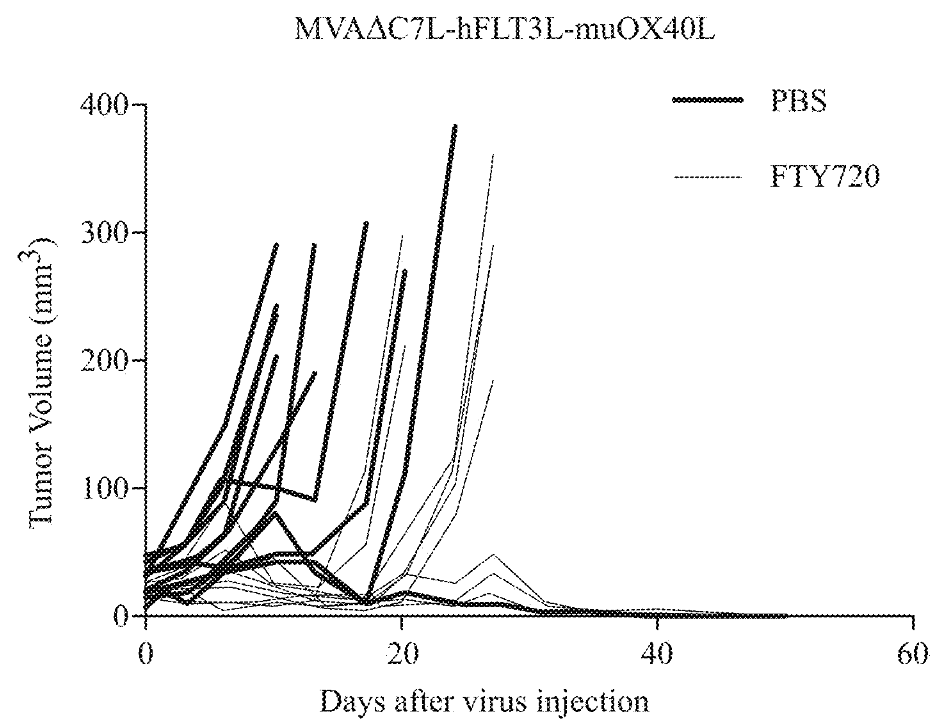
Figure 53C:
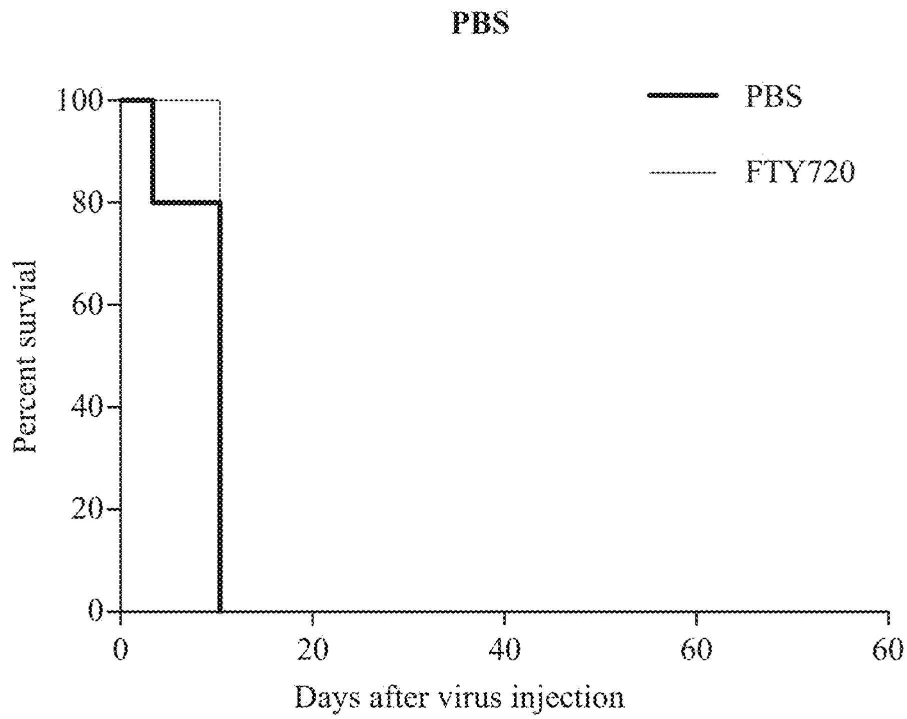
FIGS. 53C and 53D are graphs of the Kaplan-Meier survival curve of tumor-bearing mice treated with PBS or MVAΔC7L-hFlt3L-TK(−)-mOX40LC7LhFl3LmOX40Lwith or without FTY720 (n=5~10, P<0.01; *P<0.001; Mantel-Cox test).
Figure 53D:
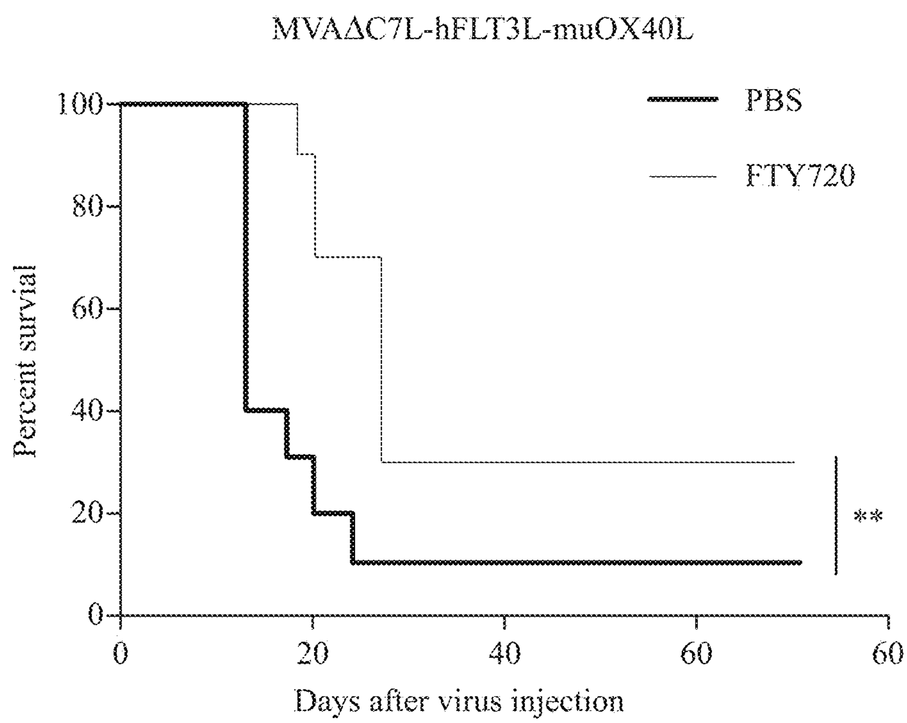

To determine whether lymph node T cell priming and activation is crucial for tumor eradication in IT MVAΔC7L-hFlt3L-TK(−)-mOX40L treatment, FTY720 (FIG. 50B) was used to block T cell exiting from lymphoid organs in a B16-F10 melanoma implantation model. Briefly, $5\times10^5$ B16-F10 melanoma cells were implanted intradermally to right flanks of C57B/6J. Nine days post tumor implantation, PBS or $4\times10^7$ pfu of MVAΔC7L-hFlt3L-TK(−)-muOX40L were intratumorally injected twice. FTY720 at 25 μg per mouse in 50% ethanol was given intraperitoneally daily during the treatment, beginning one day prior to the first MVAΔC7L-hFlt3L-TK(−)-muOX40L injection (FIG. 51). Tumor sizes were measured (FIGS. 52A-D; 53A and 53B) and survival was monitored (FIGS. 53C and 53D). FIG. 50A is a diagram demonstrating the mechanism of immune modulatory function of FTY720. After FTY720 treatment, T cells are trapped in lymph nodes. In mice treated with PBS, tumors grew rapidly and were not affected by FTY720 (FIGS. 52A and 52C). IT MVAΔC7L-hFl3L-TK(−)-muOX40L alone delayed tumor growth (FIG. 52B). FTY720 enhanced the anti-tumor effect of IT MVAΔC7L-hFl3L-TK(−)-muOX40L with delayed tumor growth (FIG.52D) and improved survival (FIG.53D). These results demonstrate that in IT MVAΔC7L-hFl3L-TK(−)-muOX40L treatment, T cells accumulated within tumors during tumor development play a crucial role in tumor eradication.

Example 54: Vaccinia E5 is highly conserved within poxvirus family.

Figure 54A:
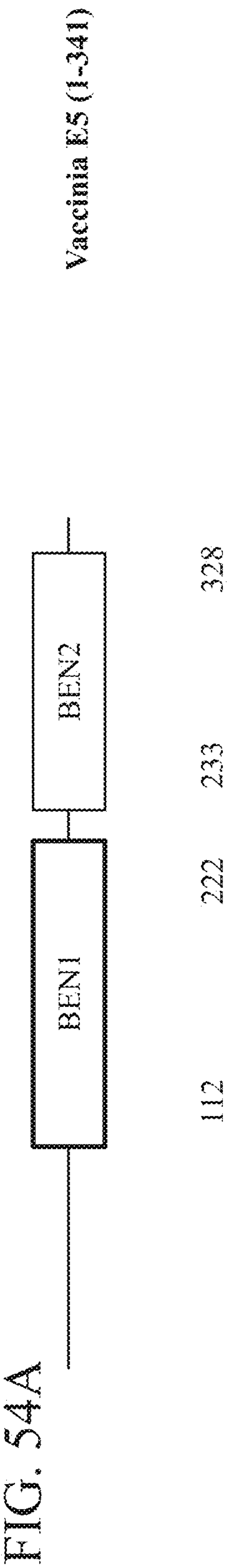
FIGS. 54A and 54B show domain organization and sequence conservation of vaccinia E5 amongst the poxvirus family.
Figure 54B:
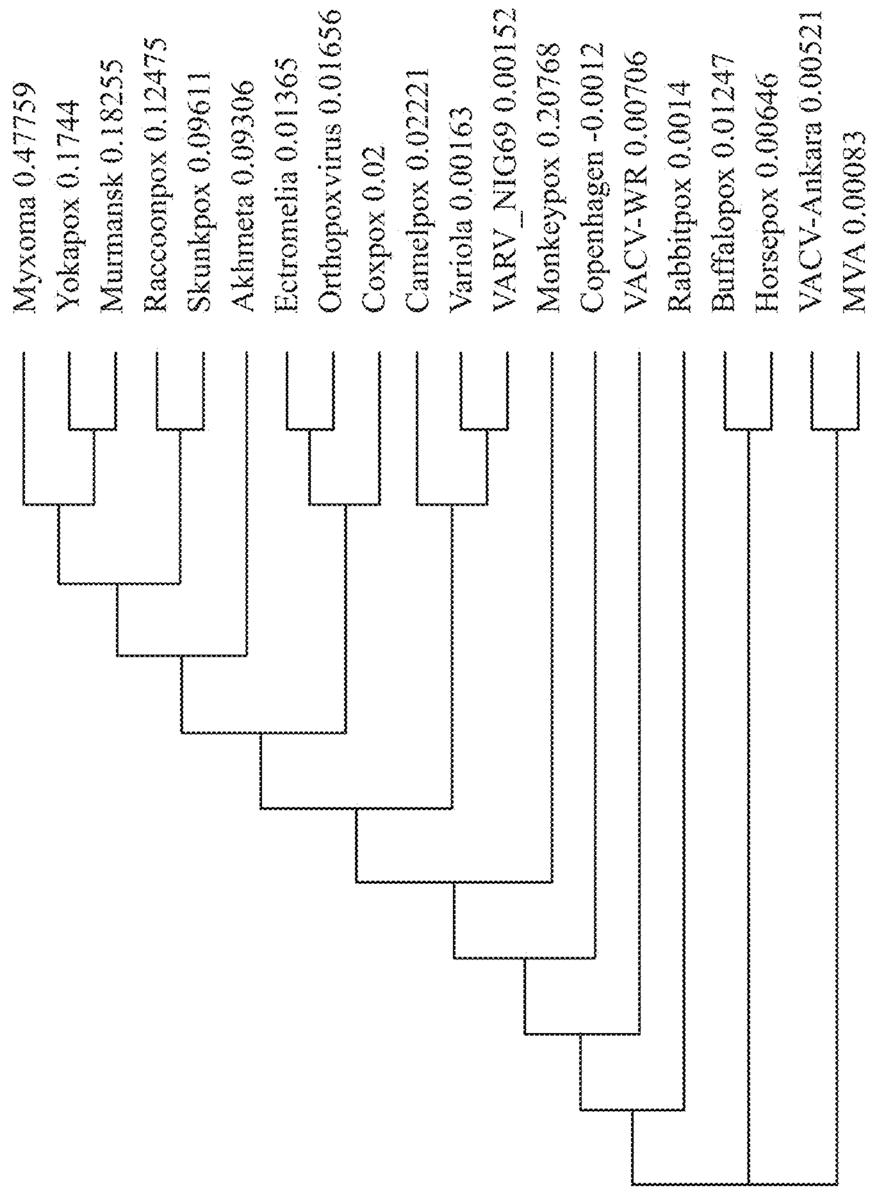

Vaccinia E5 is a 341-amino acid polypeptide, comprising two BEN domains at the C-terminus, from aa 112-222 and aa 233-328 (FIG. 54A). BEN is named after its presence in BANP/SMAR1, poxvirus E5R, and NAC1. BEN domain containing proteins are involved in chromatin organization, transcription regulation, and possibly viral DNA organization. E5 is highly conserved among poxvirus family members. The E5 ortholog of myxoma virus, which belongs to the leporipox genus is the most divergent among all of the other poxvirus family members, including variola virus, which causes smallpox in humans, ectromelia (mouse pox), cowpox, and monkeypox (FIG. 54B).

Example 55: Vaccinia E5 is a virulence factor.

Figure 55C:
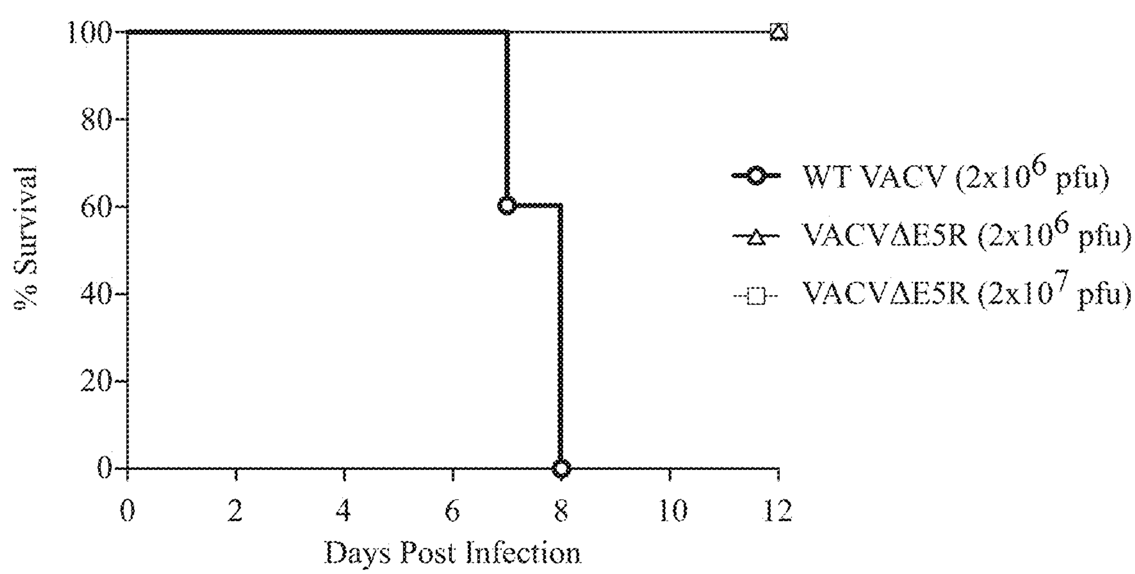

To test whether vaccinia E5 is a virulence factor, a recombinant VACVΔE5R virus was generated through homologous recombination at the flanking genes E4L and E6R. The E5R gene was replaced by the gene encoding mCherry under the control of a p7.5 promoter (FIG. 55A). An intranasal infection experiment with wild type vaccinia (WT VACV) at $2\times10^6$ pfu and vaccinia virus with deletion of E5 (VACVΔE5R) at either $2\times10^7$ pfu or $2\times10^6$ pfu was performed using 6-8 week-old C57BL/6J female mice. All of the mice infected with WT VACV lost weight quickly starting the second day of infection. All of the mice either died or were euthanized due to more than 30% weight loss at day 7 to 8 post infection (FIGS. 55B and 55C). By contrast, mice infected with either $2\times10^6$ pfu or $2\times10^7$ pfu of VACVΔE5R lost close to 15% or 20% of initial body weight on average, respectively, at day 5 and 6 post infection, and then gained weight, and recovered from the infection (FIGS. 55B and 55C). These results indicate that VACVΔE5R is highly attenuated compared with WT VACV and E5 is a virulence factor.

Example 56: VACVΔE5R induces higher levels of IFNB gene expression and IFN-β protein secretion from bone marrow-derived dendritic cells (BMDCs) compared with MVA.

Figure 56A:
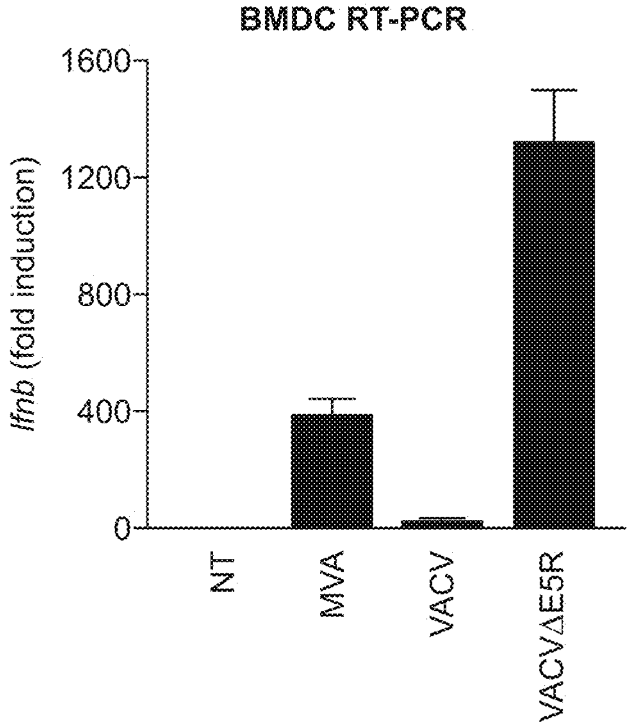
FIGS. 56A and 56B demonstrates that infection with VACVΔE5R of BMDCs induce IFNB gene expression and IFN-β protein secretion.
Figure 56B:
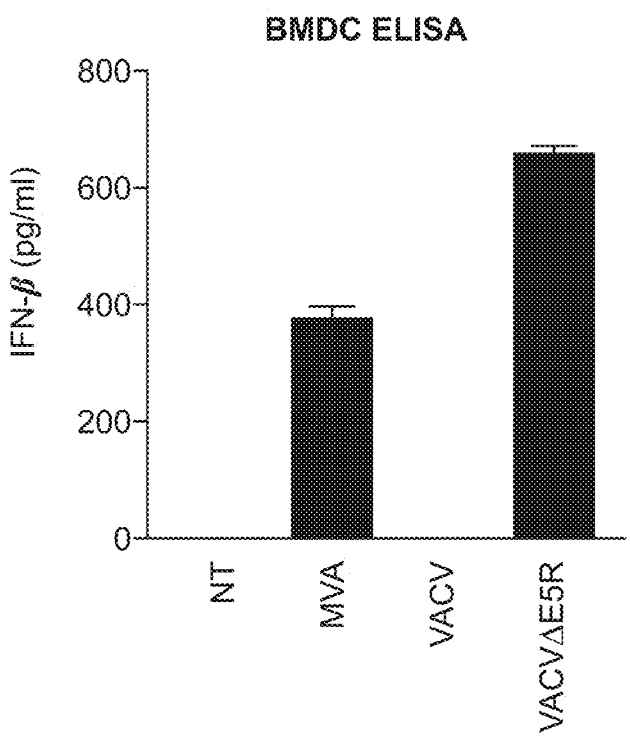

WT VACV infection of BMDCs fails to induce type I IFN, whereas MVA infection does (Dai et al. *PLOS Pathogens* (2014)). It was examined whether deletion of E5R from VACV gained the ability to induce IFNB in infected BMDCs. Bone marrow cells from C57BL/6J were cultured in the presence of GM-CSF. BMDCs were infected with either MVA, VACV, or VACVΔE5R at a MOI of 10. Cells were collected at 6 h post infection. RNAs were extracted and RT-PCRs were performed. Supernatants were collected at 21 h post infection and IFN-β levels were measured by ELISA. RT-PCR results demonstrated that WT VACV infection of BMDCs induced a 29-fold IFNB gene expression compared with no-treatment control (NT), MVA infection induced 387-fold and VACVΔE5R induced 1316-fold (FIG. 56A). ELISA results demonstrated that VACV infection of BMDCs failed to induce IFN-β secretion from BMDCs. However, IFN-β levels in the supernatants of BMDCs infected with either MVA or VACVΔE5R were 375.5 pg/ml and 660 pg/ml, respectively (FIG. 56B). These results indicate that VACVΔE5R induces higher levels of IFNB gene expression and IFN-β protein secretion from BMDCs compared with MVA.

Example 57: MVAΔE5R induces higher levels of IFNB gene expression in BMDCs and BMDMs compared with MVA.

Figure 57A:
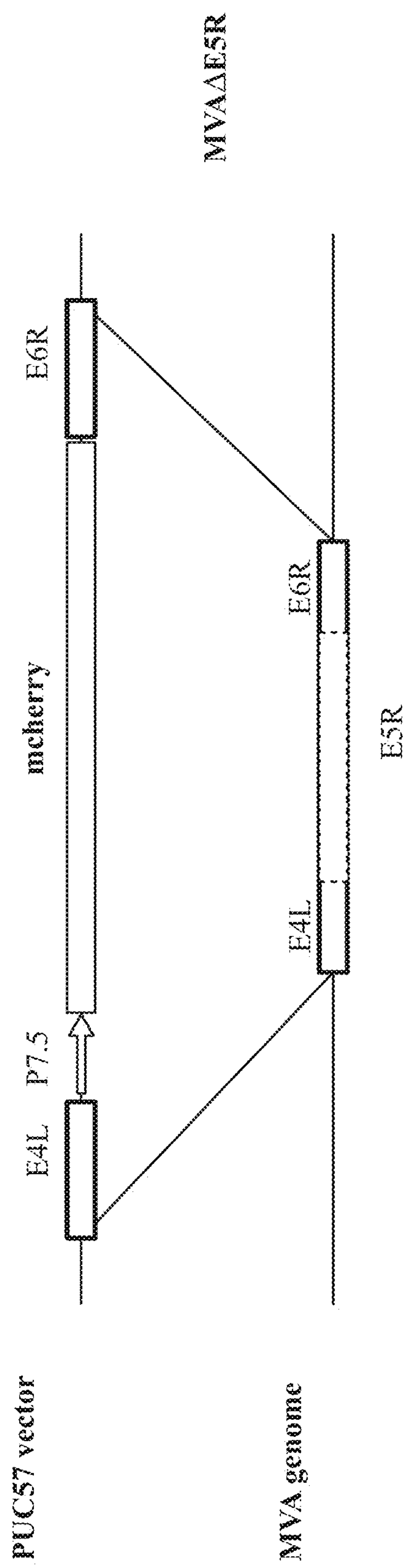
FIGS. 57A-57D show IFNB gene induction by MVAΔE5R and MVAΔK7R in BMDCs and BMDMs.
Figure 57B:
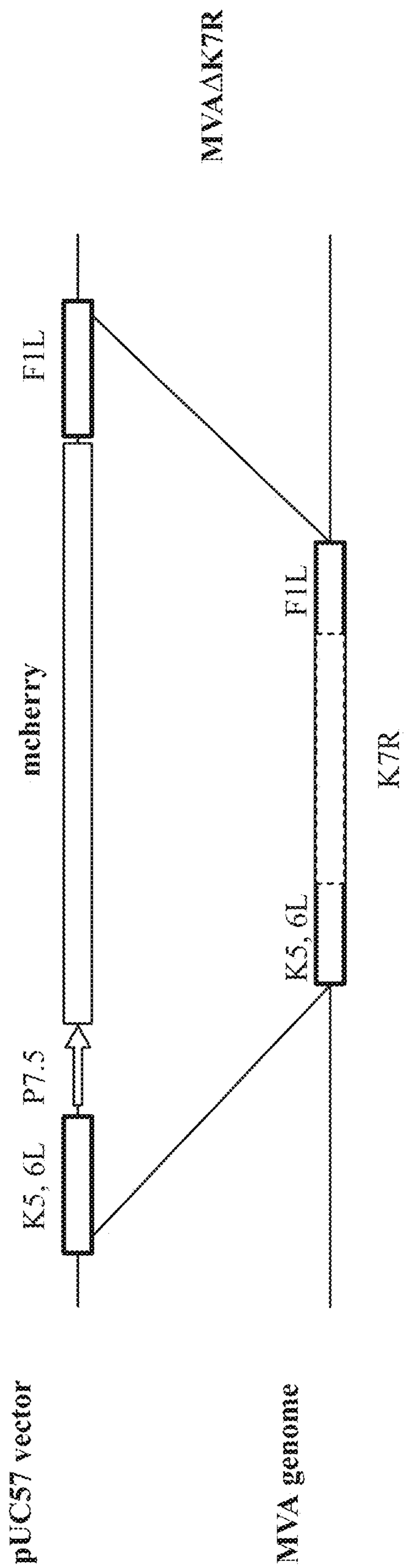

To test whether deletion of E5 from MVA genome also enhances its ability to induce IFNB gene induction, a recombinant MVAΔE5R was generated through homologous recombination at the flanking genes E4L and E6R, which resulted in the replacement of the E5R gene by the gene encoding mCherry under the control of a p7.5 promoter (FIG. 57A). A recombinant MVAΔK7R was also generated through homologous recombination at the flanking genes K5,6L and F1L, which also resulted in the replacement of the K7R gene by the gene encoding mCherry under the control of a p7.5 promoter (FIG. 57B).

BMDCs or BMDMs were generated by culturing bone marrow cells in the presence of GM-CSF or M-CSF, respectively. BMDCs and BMDMs were infected with either MVA, MVAΔE5R, or MVAΔK7R at a MOI of 10. Cells were collected at 6 h post infection. RT-PCR demonstrated that MVAΔE5R, MVAΔK7R, or MVA infection of BMDCs resulted in 2452-fold, 22-fold, or 12-fold induction of IFNB gene, respectively, compared with a “Blank” control (FIG. 57C). In BMDMs, MVAΔE5R, MVAΔK7R, or MVA infection resulted in 4510-fold, 35-fold, or 4-fold induction of IFNB gene expression compared with a “Blank” control (FIG. 57D). These results demonstrate that E5 is a dominant inhibitor of IFNB gene induction in BMDCs and BMDMs, and deletion of E5 from the MVA genome leads to a dramatic induction of IFNB. These results also demonstrate that K7 is also an inhibitor of IFNB gene induction in BMDCs and BMDMs.

Example 58: MVAΔE5R induces higher levels of IFNA, CCL4, and CCL5 gene expression in BMDCs compared with MVA.

BMDCs were infected with either MVA or MVAΔE5R at a MOI of 10. Cells were collected at 6 h post infection. RT-PCR analyses demonstrated that MVAΔE5R also induced much higher levels of IFNA (FIG. 58A), CCL4 (FIG. 58B), and CCL5 (FIG. 58C) gene expression compared with MVA. These results suggest that MVAΔE5R infection triggers the induction of type I IFN and chemokines that may facilitate the recruitment immune cells into the site of infection.

Example 59: MVAΔE5R induces higher levels of IFNB gene expression compared with Heat-inactivated MVAΔE5R (Heat-iMVAΔE5R).

Figure 59A:
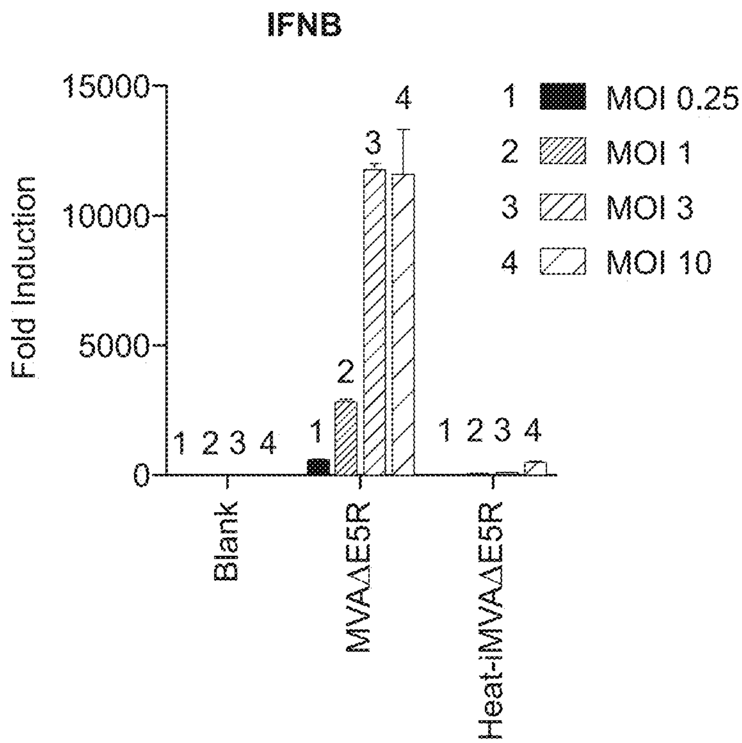
FIGS. 59A-59C show that MVAΔE5R infection of BMDCs induce high levels of IFNB and viral E3R gene expression and IFN-β protein secretion from BMDCs.
Figure 59B:
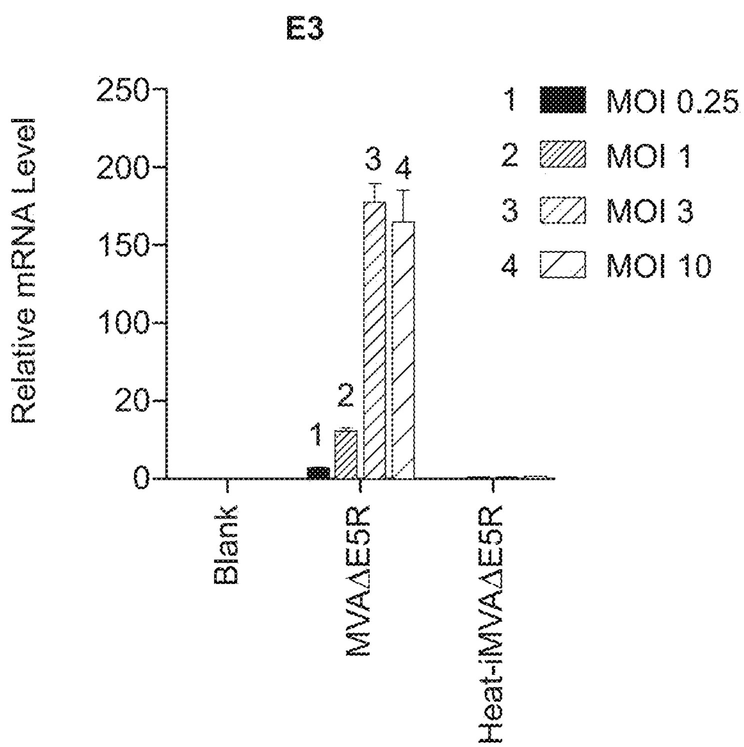
Figure 59C:
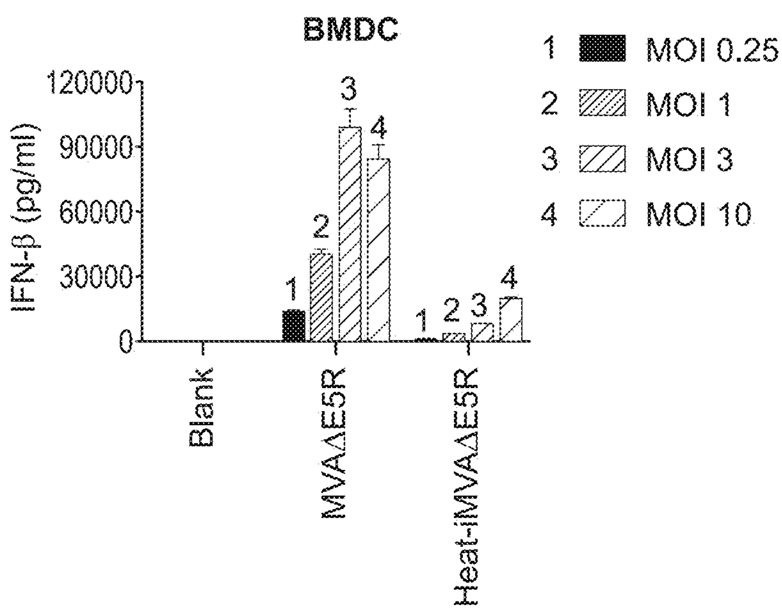

Heat-inactivated MVA induces higher levels of type I IFN and proinflammatory cytokines and chemokines compared with live MVA (Dai et al. *Science Immunology* (2017)). The induction of IFNB gene expression and IFN-β secretion by MVAΔE5R-vs. Heat-iMVAΔE5R-infected BMDCs was examined. Briefly, BMDCs were infected with either MVAΔE5R or Heat-iMVAΔE5R at MOIs of 0.25, 1, 3, or 10. Cells were washed after 1 h infection and fresh medium was added. Cells and supernatants were collected at 14 h post infection. IFNB and E3 gene expressions were determined by RT-PCR. IFN-β protein levels in the supernatants were determined by ELISA. RT-PCR results show that MVAΔE5R induces IFNB gene expression and IFN-β secretion in a dose-dependent manner, and the induction was much higher compared with Heat-iMVAΔE5R. At MOIs of 3 or 10, MVAΔE5R resulted in the maximum levels of induction of IFNB gene expression and IFN-β protein secretion (FIGS. 59A and 59C). MVAΔE5R expressed vaccinia E3 gene, whereas Heat-inactivated MVAΔE5R failed to express as expected (FIG. 59B).

Example 60: MVAΔE5R-induced IFNA and IFNB gene expression and IFN-b protein secretion from BMDCs require the cytosolic DNA sensor cGAS.

Figure 60B:
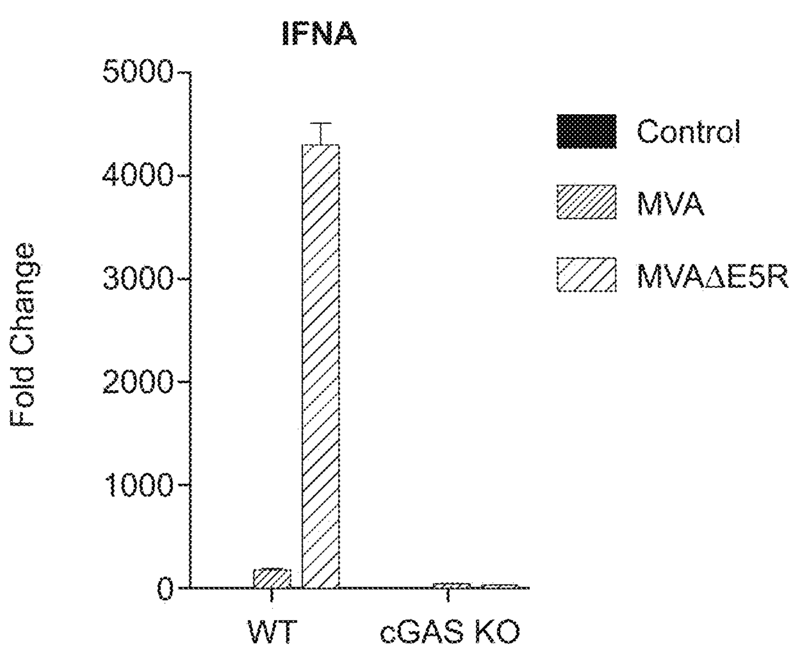
Figure 60C:
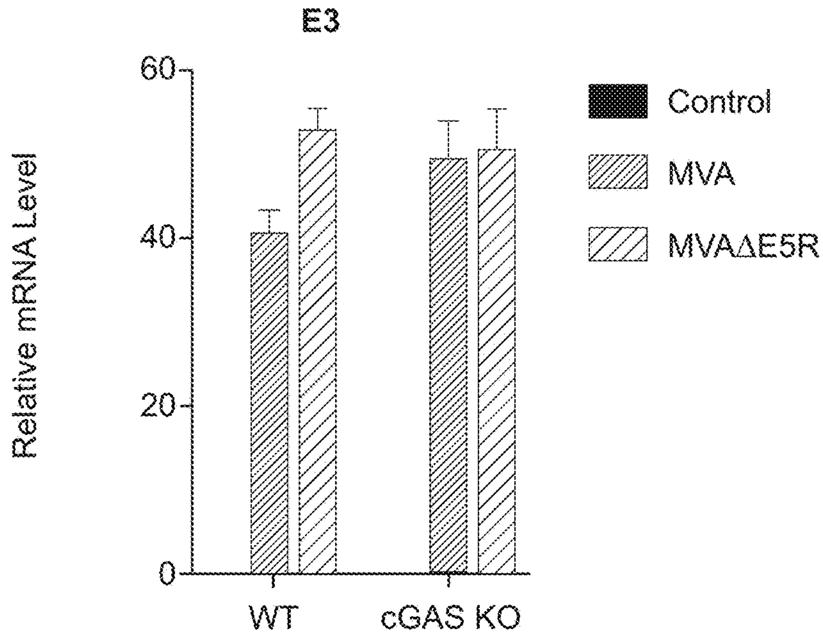
Figure 60D:
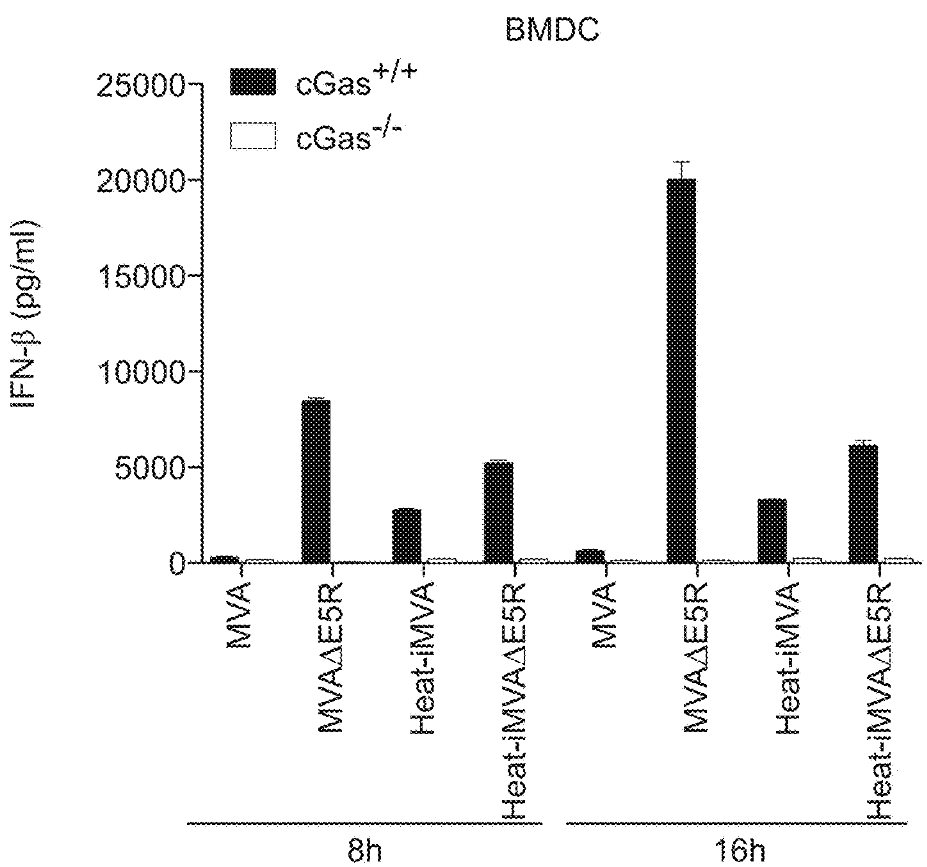

MVAΔE5R infection of BMDCs induced high levels of IFNA and IFNB gene induction and IFN-β protein secretion compared with live MVA, Heat-inactivated MVA, or Heat-inactivated MVAΔE5R. To determine whether cGAS is required for MVAΔE5R-induced IFN gene expression and protein secretion, BMDCs from WT and $cGAS^{-/-}$ mice were generated, and were infected with either MVA or MVAΔE5R at a MOI of 10. Cells were collected at 6 h post infection. RT-PCR analysis showed that MVAΔE5R-induced IFNB (FIG. 60A) and IFNA (FIG. 60B) gene expression is dependent on cGAS, whereas both MVA and MVAΔE5R express E3L gene in either WT or $cGAS^{-/-}$ cells (FIG. 60C). BMDCs from WT and $cGAS^{-/-}$ mice were infected with either MVA, MVAΔE5R, Heat-iMVA, or Heat-iMVAΔE5R at a MOI of 10, and supernatants were collected at 8 and 16 h post infection. IFN-β protein levels in the supernatants were measured by ELISA. MVAΔE5R-induced higher levels of IFN-β secretion from WT BMDCs compared with MVA, Heat-iMVA, or Heat-iMVAΔE5R at 8 h post infection. At 16 h post infection, the IFN-β level of the supernatant from MVAΔE5R-infected WT BMDCs rose even higher compared with that in the supernatant collected at 8 h post infection (FIG. 60D). The induction of IFN-β secretion by MVAΔE5R-infected BMDCs was completely dependent on cGAS (FIG. 60D).

Example 61: MVAΔE5R-induced IFNB gene expression and IFN-b protein secretion from BMDCs and BMDMS require STING.

Figure 61A:
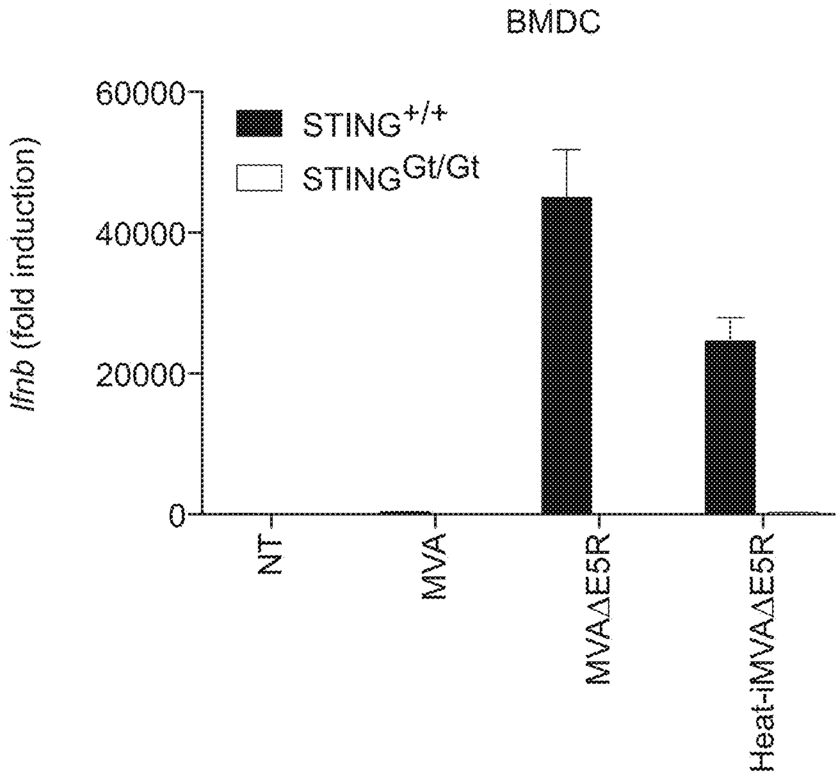
FIGS. 61A and 61B show MVAΔE5R-induced IFNB gene expression and protein secretion from BMDCs is dependent on STING.
Figure 61B:
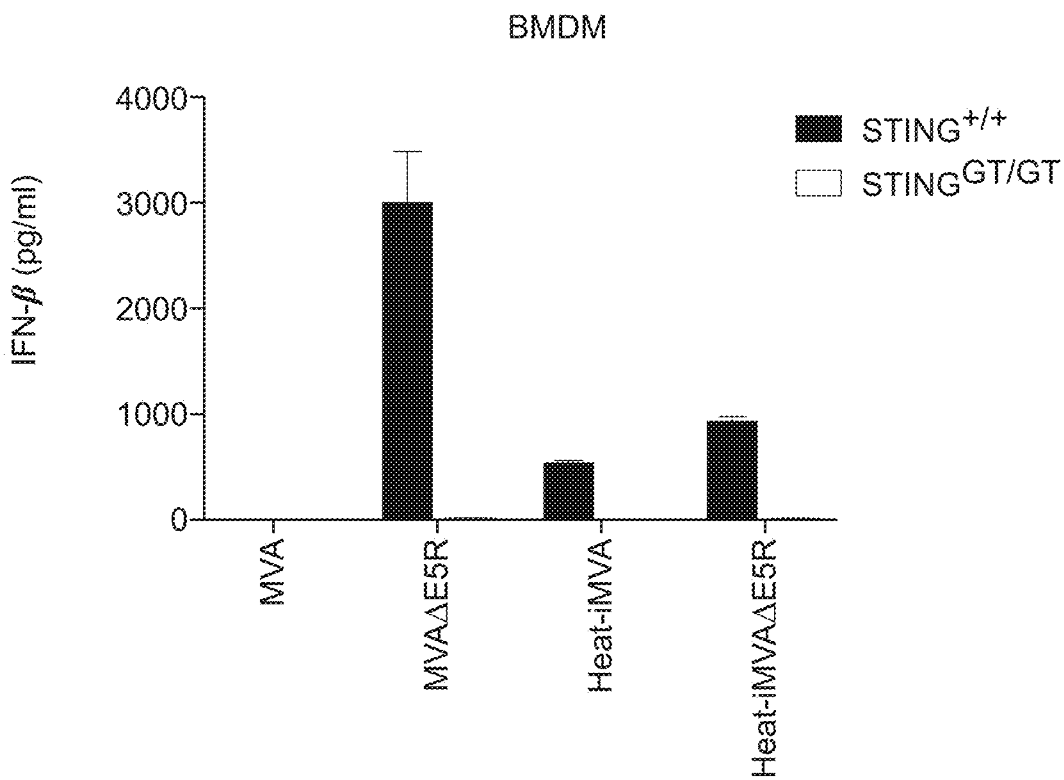

STING is an endoplasmic reticulum (ER)-localized protein critical for the cytosolic DNA-sensing pathway. Upon DNA-binding, cGAS is activated and generates a second messenger cyclic GMP-AMP (cGAMP) from ATP and GTP. cGAMP binds to STING and subsequently activates STING, which leads to activation of transcription factor IRF3, and IFNB gene induction. To test whether MVAΔE5R-induced IFNB gene expression and IFN-β protein secretion requires STING, BMDCs and BMDMs from age-matched WT and $STING^{GtU/Gt}$ micewere generated, which lack functional STING protein. MVAΔE5R and Heat-iMVAΔE5R induced IFNB gene expression in WT BMDCs, but not in $STING^{Gt/Gt}$ cells (FIG. 61A). Similarly, MVAΔE5R induced IFN-β protein secretion in WT BMDMs, but not in $STING^{Gt/Gt}$ cells (FIG. 61B).

Example 62: MVAΔE5R-induced IFN-β protein secretion from BMDCs require IRF3, IRF7 and IFNAR1.

Figure 62A:
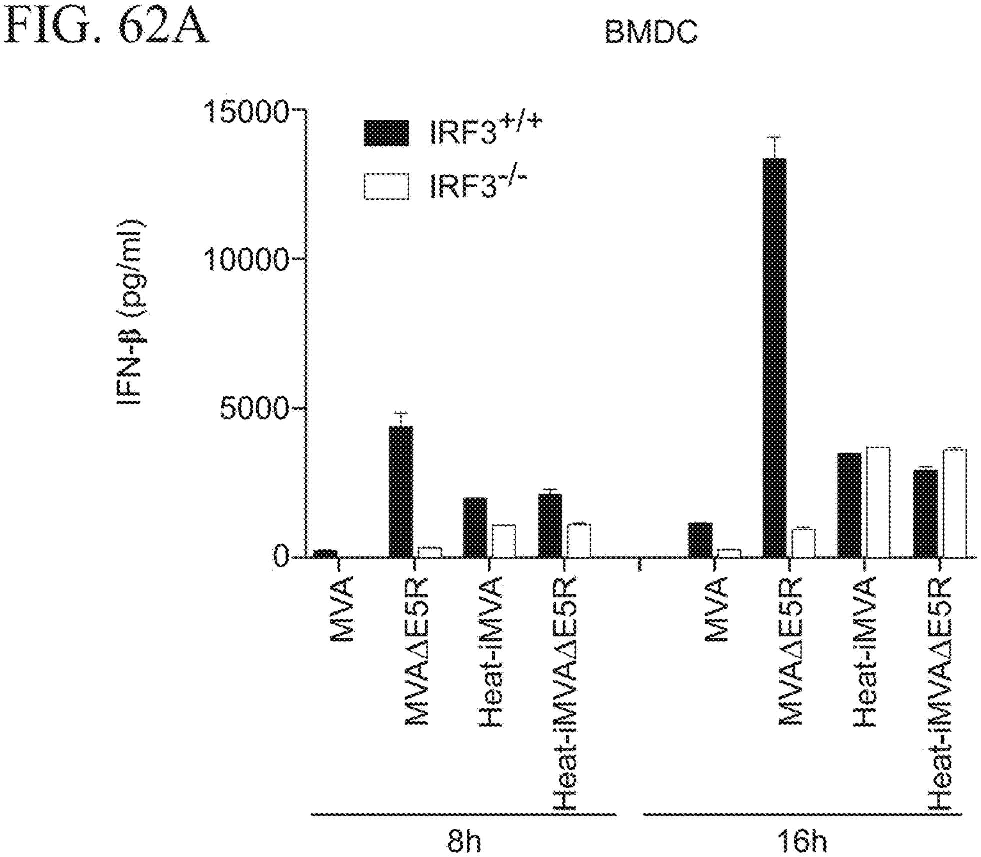
FIGS. 62A-62D show that MVAΔE5R-induced IFN-β protein secretion requires IRF3,IRF7 and IFNAR.
Figure 62B:
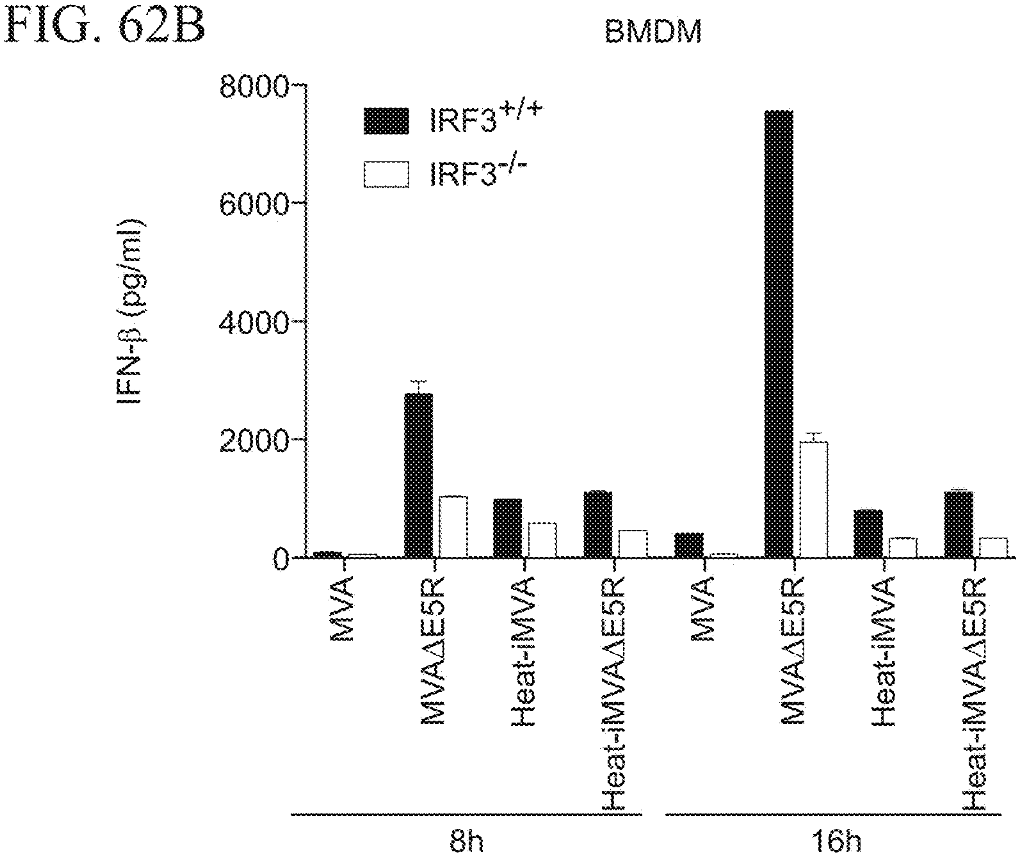

Transcription factors IRF3 and IRF7 are important for the induction of IFNB gene expression. Type I IFNs, once secreted, bind to IFNAR, which leads to the activation of JAK/STAT pathway and the induction of IFN-stimulated genes (ISGs). To determine whether IRF3,IRF7, and IFNARI were required for the induction of IFN-β protein secretion from BMDCs and BMDMs, BMDCs and BMDMs from WT and $IRF3^{-/-}$-mice were infected with either MVA, MVAΔE5R, Heat-iMVA, or Heat-iMVAΔE5R. Supernatants were collected at 8 and 16 h post infection. The IFN-β protein levels in the supernatants were determined by ELISA. MVAΔE5R-induced IFN-β secretion at both 8 and 16 h was reduced by 96% and 94% in $IRF3^{-/-}$-BMDCs, respectively (FIG. 62A). In addition, MVAΔE5R-induced IFN-β secretion at both 8 and 16 h was reduced by 63% and 75% in $IRF3^{-/-}$-BMDCs, respectively (FIG. 62B).

Figure 62C:
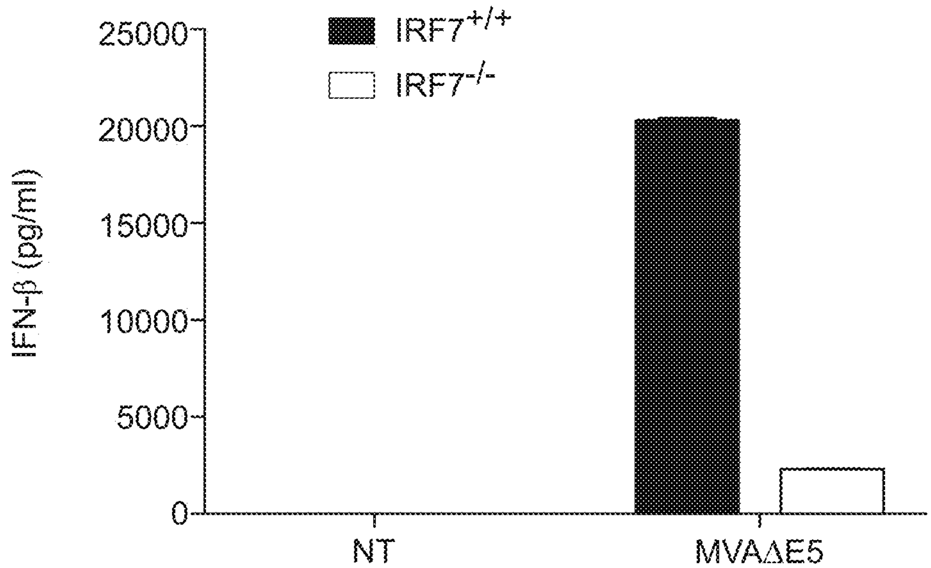

BMDCs from WT and $IRF7^{-/-}$-mice were infected with MVAΔE5R at a MOI of 10 or treated with mock control. Supernatants were collected at 16 h post infection. The IFN-β protein levels in the supernatants were determined by ELISA. MVAΔE5R-induced IFN-β secretion was reduced by 89% in $IRF7^{-/-}$ BMDCs (FIG. 62C).

Figure 62D:
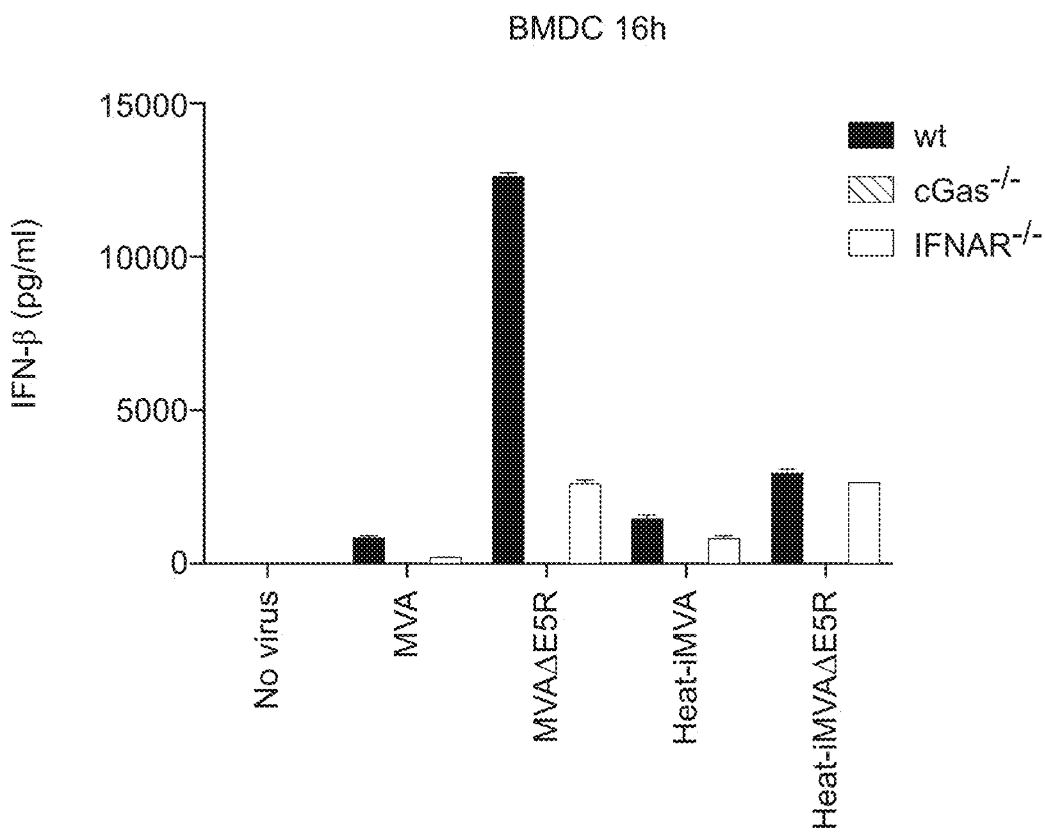

BMDCs from WT, $cGAS^{-/-}$, or $IFNAR1^{-/-}$ mice were infected with either MVA, MVAΔE5R, Heat-iMVA, or Heat-iMVAΔE5R. Supernatants were collected at 16 h post infection. The IFN-β protein levels in the supernatants were determined by ELISA. MVAΔE5R-induced IFN-β secretion was abolished in $cGAS^{-/-}$ BMDCs and was reduced by 79% in $IFNAR1^{-/-}$-BMDCs (FIG. 62D).

Taken together, these results demonstrate that IRF3/IRF7/IFNAR1 play important roles in the induction of IFN-β production by BMDCs.

Example 63: WT VACV-induced cGAS degradation is mediated through a proteasome-dependent pathway.

Figure 63A:
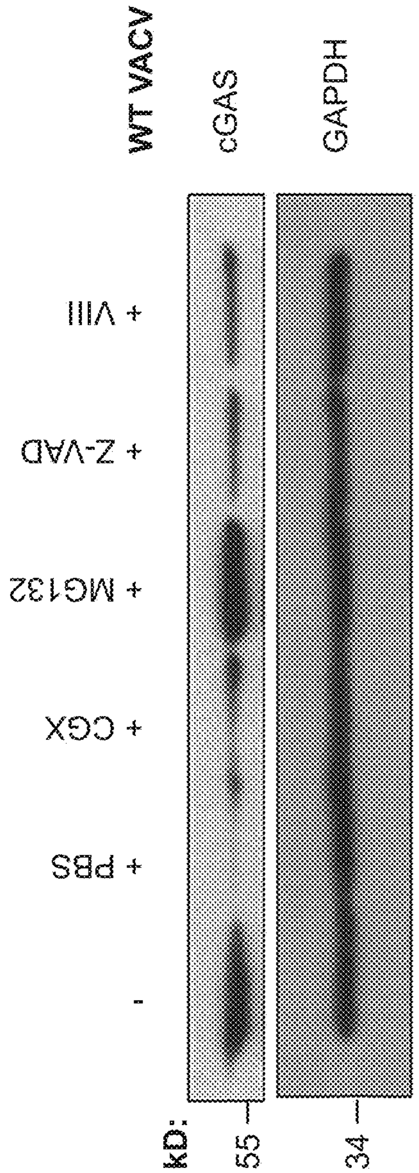
FIGS. 63A-63C demonstrate that WT VACV-induced cGAS degradation is mediated through a proteasome-dependent pathway.
Figure 63B:
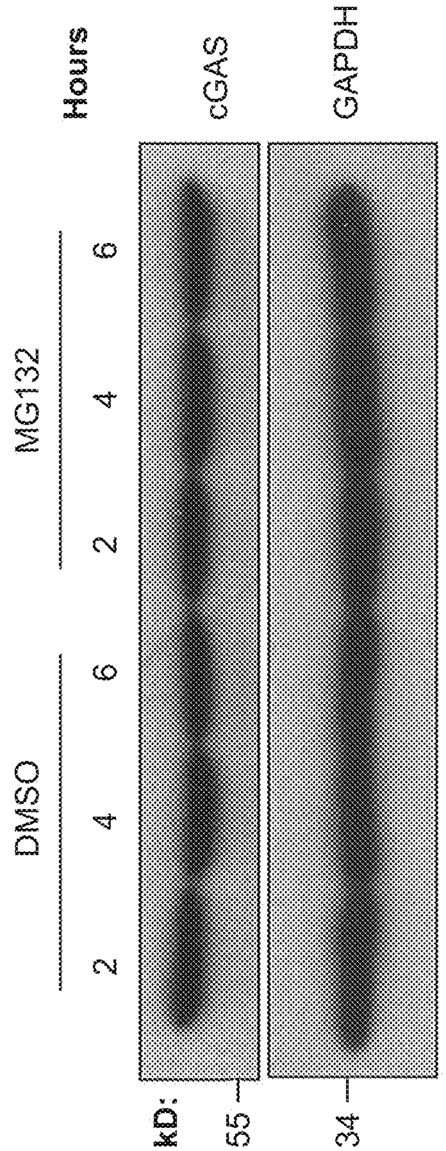
Figure 63C:
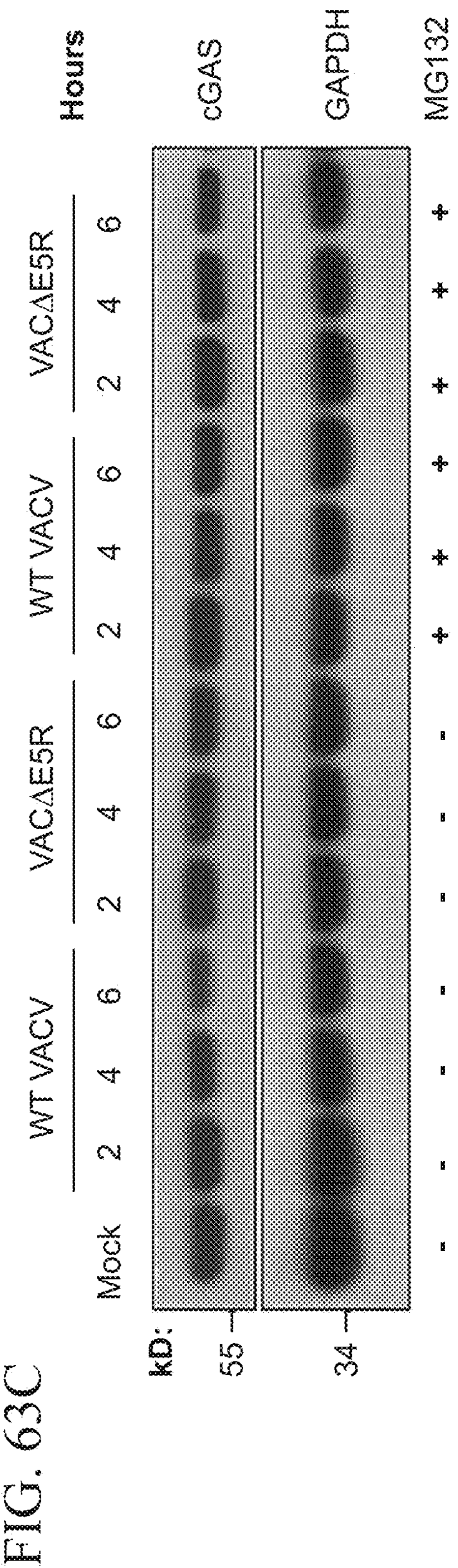

It has been determined that WT VACV infection triggers degradation of cGAS in murine embryonic fibroblasts (MEFs) and BMDCs. To determine the mechanism of VACV-induced cGAS degradation, MEFs were pre-treated with either cycloheximide (CHX); a proteasomal inhibitor, MG132; a pan-caspase inhibitor, Z-VAD; or an AKT1/2 inhibitor VIII for 30 min. MEFs were then infected with WT VACV in the presence of each drug. Cells were collected at 6 h post infection. Western blot analysis demonstrated that in the presence of MG132, WT VACV-induced cGAS degradation was blocked (FIG. 63A). As a control, treatment of MEFs with either DMSO or MG132 did not affect cGAS protein level (FIG. 63B). To test whether vaccinia E5 is responsible for WT VACV-mediated cGAS degradation, BMDCs were infected with either WT VACV or VACVΔE5R in the presence or absence of MG132 (FIG. 63C). Whereas WT VACV infection of BMDCs resulted in cGAS degradation, VACVΔE5R infection did not. In addition, WT VACV-induced cGAS degradation was blocked in the presence of MG132. These results further support that E5 of vaccinia virus is responsible for WT VACV-induced cGAS degradation.

Example 64: The E5R gene in MVA is important in mediating cGAS degradation in BMDCs.

Figure 64:
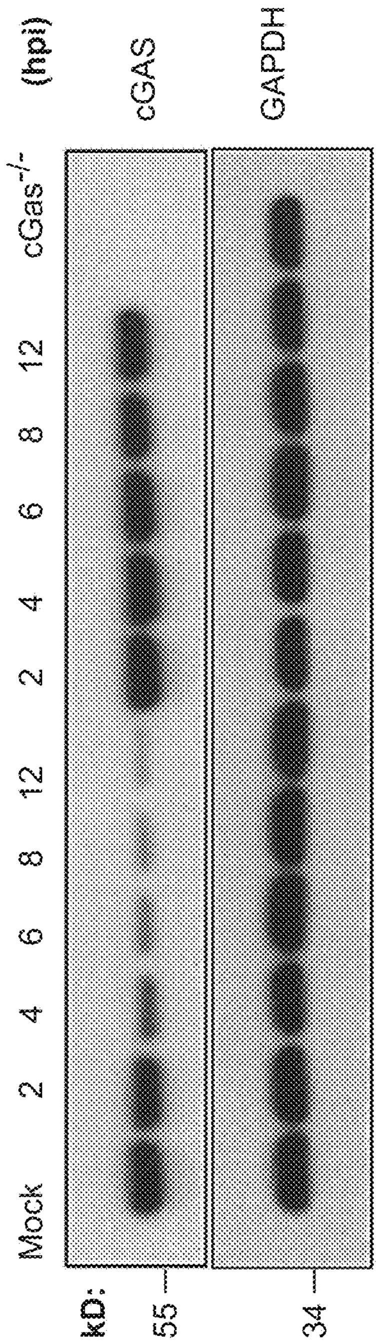
FIG. 64 demonstrates that the E5R gene in MVA is important in mediating cGAS degradation in BMDCs. BMDCs were infected with either MVA or MVAΔE5R at a MOI of 10. Cells were collected at 2, 4, 6, 8, and 12 h post infection. Western blot analysis was performed using anti-cGAS and anti-GAPDH antibodies.

To test whether the E5R gene in MVA has similar role to vaccinia E5R gene, BMDCs were infected with either MVA or MVAΔE5R at a MOI of 10. Cells were collected at 2, 4, 6, 8, and 12 h post infection. A $cGAS^{-/-}$ BMDC sample without infection was also included. Western blot analysis showed that infection of BMDCs with MVA also caused rapid degradation of cGAS, whereas infection with MVAΔE5R resulted in much less cGAS degradation (FIG. 64). These results demonstrate that the E5R gene in MVA is also responsible for cGAS degradation.

Example 65: MVAΔE5R induces higher levels of phosphorylated Stat2 compared with MVA.

Figure 65:
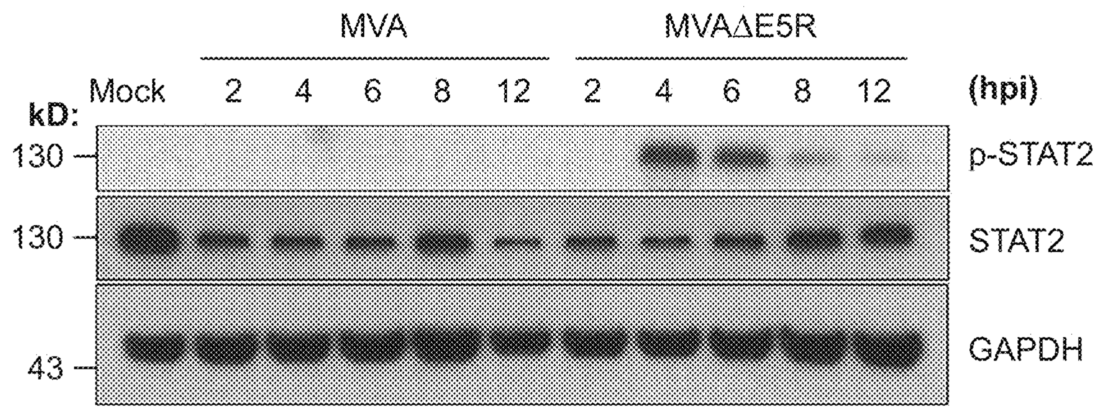
FIG. 65 demonstrates that MVAΔE5R induces higher levels of phosphorylated Stat2 compared with MVA. BMDCs were infected with either MVA or MVAΔE5R at a MOI of 10. Cells were collected at 2, 4, 6, 8, and 12 h post infection. Western blot analysis was performed using anti-phospho-STAT2, anti-STAT2, and anti-GAPDH antibodies.

To test whether MVAΔE5R infection of BMDCs triggers a stronger IFNR down-stream signaling, BMDCs were infected with either MVA or MVAAER at a MOI of 10. Cells were collected at 2, 4, 6, 8, and 12 h post infection. Western blot analysis was performed using anti-phospho-STAT2, anti-STAT2, and anti-GAPDH antibodies (FIG. 65). The results demonstrate that MVAΔE5R induces higher levels of p-STAT2, especially at 4 and 6 h post infection, compared with MVA. STAT2 is an important transcription factor for the induction IFN-stimulated genes. Phosphorylated STAT2 translocates from the cytoplasm to the nucleus to bind to IFN-sensitive response element (ISRE), which leads to the induction of ISG expression. These results indicate that MVAΔE5R infection can trigger stronger induction of hundreds of ISGs through p-STAT2 compared with MVA. Some ISGs are important cytokines and chemokines, which are important for T cell activation and recruitment of other immune cells to the site of infection.

Example 66: MVAΔE5R induces high levels of cGAMP production in infected BMDCs.

Figure 66:
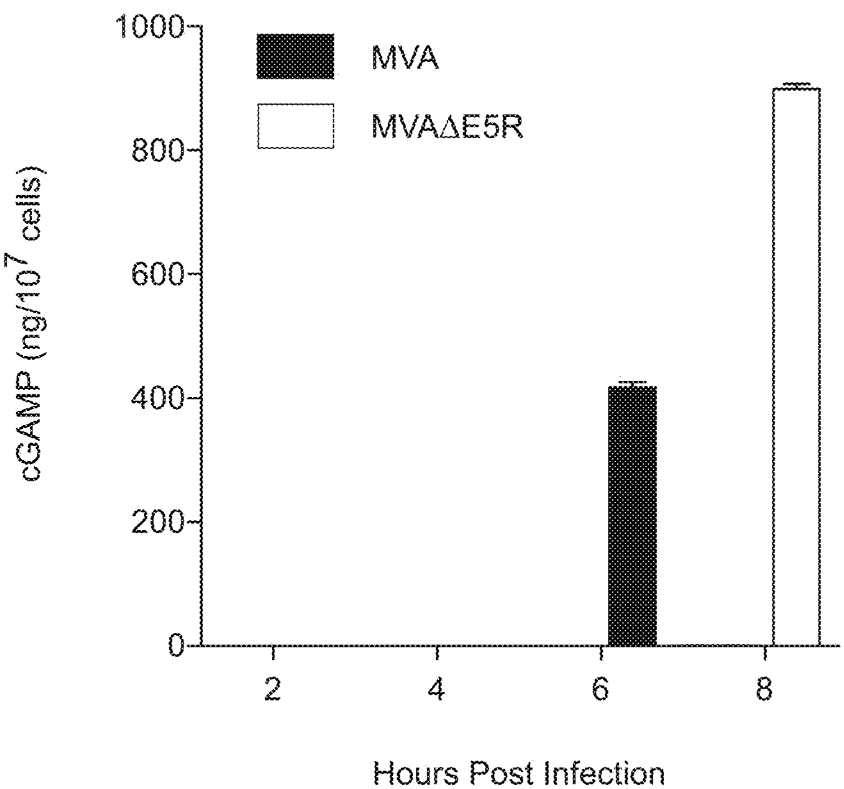
FIG. 66 shows that MVAΔE5R induces high levels of cGAMP production in infected BMDCs. $2.5\times10^6$ BMDCs were infected with either MVA or MVAΔE5R at a MOI of 10. Cells were collected at 2, 4, 6 and 8 h post infection. cGAMP concentrations were measured by incubating cell lysates with permeabilized differentiated THP1-Dual™ cells, which were derived from the human THP-1 monocyte cell line by stable integration of two inducible reporter constructs. Supernatants were collected at 24 h, and luciferase activities (as an indication for IRF pathway activation) were measured. cGAMP levels were calculated by comparing with cGAMP standards.

Upon DNA binding, cGAS is activated, and converts ATP and GTP to cyclic GMP-AMP (cGAMP), which acts as a second messenger, resulting in the activation of the STING/TBK1/IRF3 axis and induction of type I IFN. To determine whether MVAΔE5R leads to higher levels of cGAMP production, $2.5\times10^6$ BMDCs were infected with either MVA or MVAΔE5R at a MOI of 10. Cells were collected at 2, 4, 6 and 8 h post infection. cGAMP concentrations were measured by incubating cell lysates with permeabilized differentiated THP1-Dual™ cells, which were derived from the human THP-1 monocyte cell line by stable integration of two inducible reporter constructs (FIG. 66). Supernatants were collected at 24 h, and luciferase activities (as an indication for IRF pathway activation) were measured. cGAMP levels were calculated by comparing with cGAMP standards. MVAΔE5R induced close to 400 ng/$10^7$ cells at 6 h post infection, and 900 ng/$10^7$ cells at 8 h post infection. By contrast, MVA-induced cGAMP level was not detectable by this method, which is less sensitive than mass spectrometry. Given the increase of cGAMP levels produced during the first 8 h of MVAΔE5R infection, it is plausible that E5 protein not only prevents parental viral DNA recognition by cGAS, it also prevents detection of progeny viral DNA by cGAS. E5 has been shown to be in the virosomes/viral factories, where viral DNA replication occurs. These results indicate that E5 inhibits cGAMP production by cGAS.

Figure 67A:
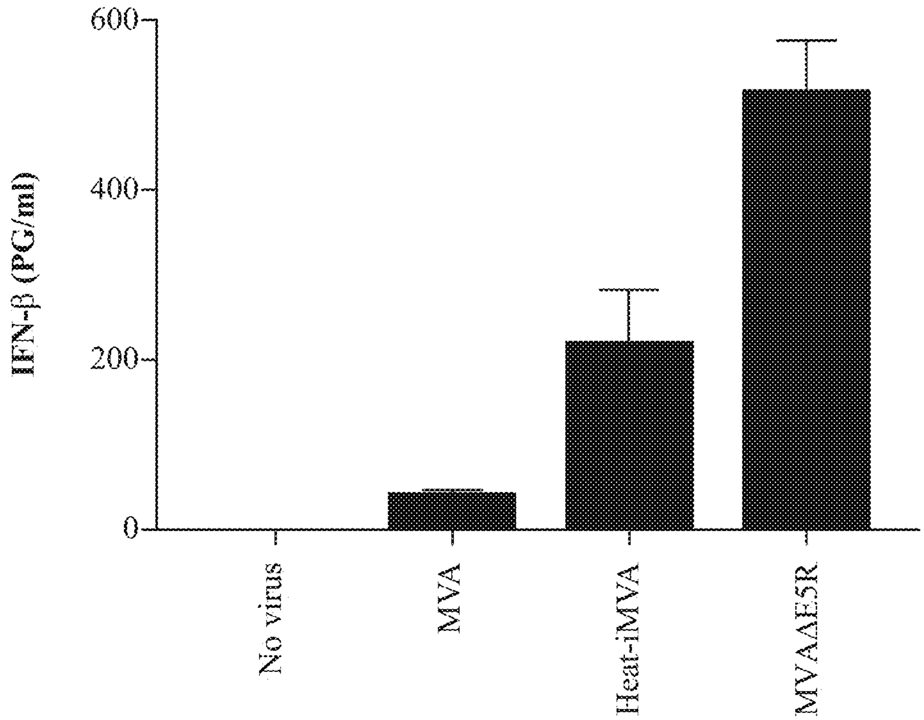
FIGS. 67A and 67B show that MVAΔE5R induces IFN-β protein secretion from plasmacytoid dendritic cells.
Figure 67B:
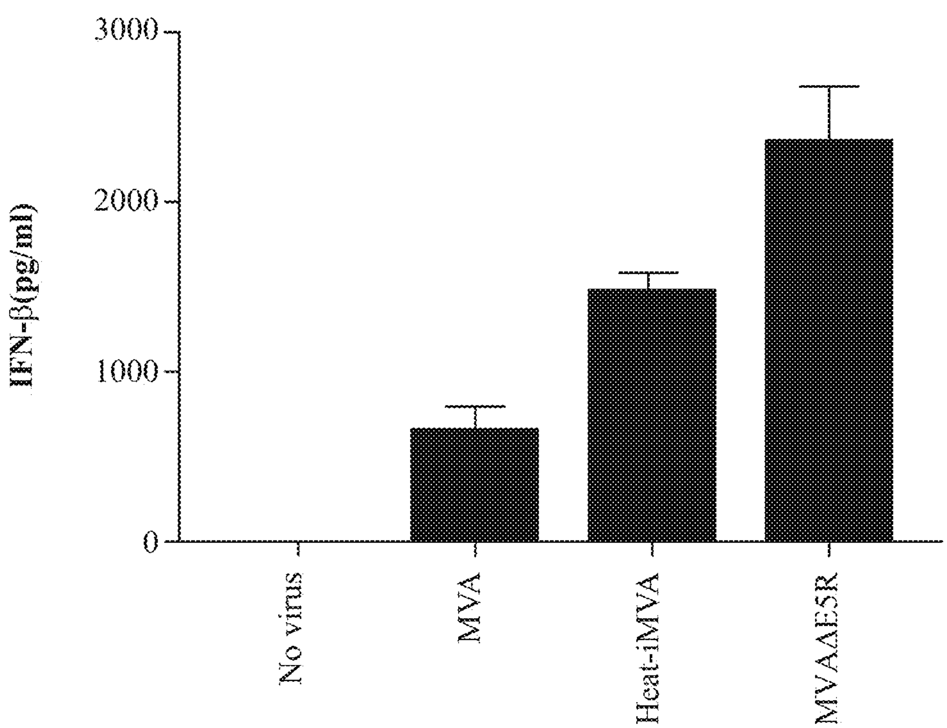

Example 67: MVAΔE5R induces IFN-β protein secretion from plasmacytoid dendritic cells (pDCs).

pDCs are potent type I IFN producing cells. To test whether MVAΔE5R infection of pDCs induces type I IFN production, $1.2\times10^5$ pDCs ($B220^+PDCA\text{-}1^+$) sorted from splenocytes were infected with either MVA, Heat-iMVA, or MVAΔE5R. Non-infected splenocytes were included as a control. Supernatants were collected at 18 h post infection. IFN-β levels in the supernatants were measured by ELISA. MVAΔE5R induced higher levels of IFN-β protein secretion from splenic pDCs compared with MVA and Heat-iMVA (FIG. 67A); 517.5 pg/ml in the supernatants from MVAΔE5R-infected splenic pDCs vs. 43.5 pg/ml in the supernatants from MVA-infected splenic pDCs vs. 220 pg/ml in the supernatants of Heat-iMVA-infected splenic pDCs (FIG. 67A).

Figure 68:
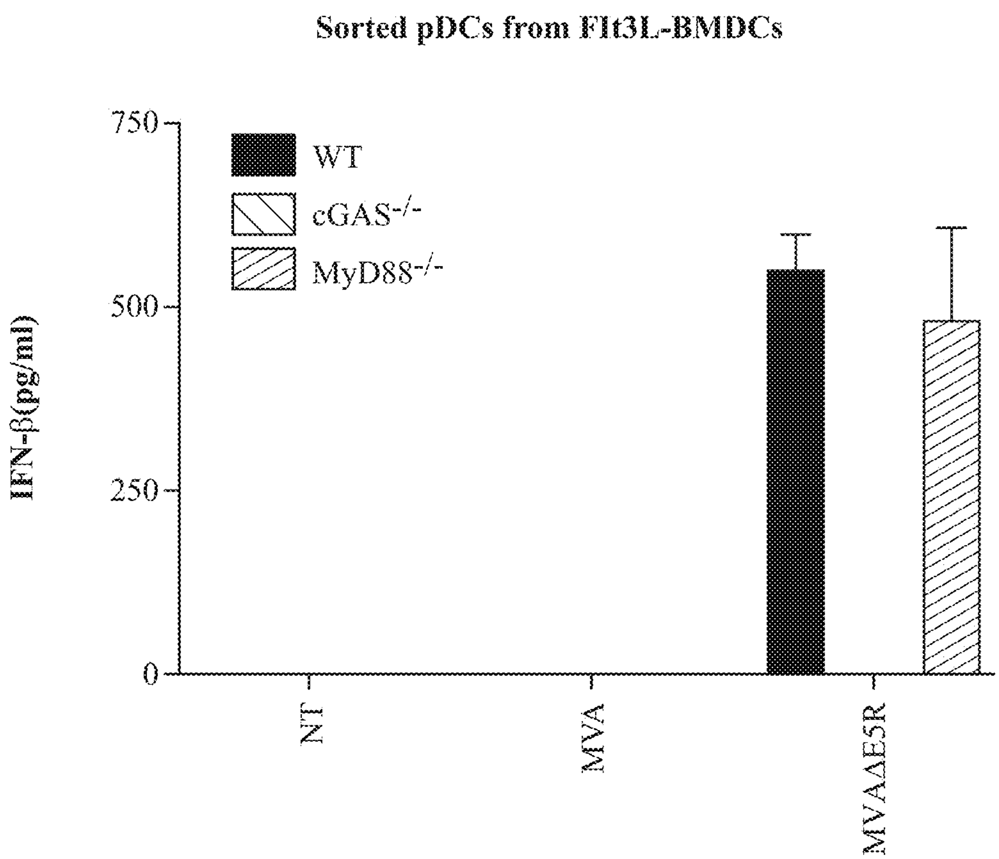
FIG. 68 shows that MVAΔE5R-induced IFN-Δ secretion from pDCs is dependent on cGAS. pDCs were sorted from Flt3L-cultured BMDCs ($B220^+PDCA-1^+$) obtained from WT, $cGAS^{-/-}$, or $MyD88^{-/-}$-mice. $2\times10^5$ cells were infected with either MVA or MVAΔE5R. NT control was included. Supernatants were collected at 18 h post infection. IFN-β levels in the supernatants were measured by ELISA.

Example 68: MVAΔE5R-induced IFN-β protein secretion from pDCs is dependent on cGAS.

pDCs commonly use endosomal-localized TLR7 and TLR9 to detect endosomal RNA and DNA to elicit strong type I IFN responses. MyD88 is an adaptor for both TLR7 and TLR9. More recently, it has been shown that cGAS is also important for detecting cytosolic DNA in pDCs. To test whether cGAS or MyD88 pathway is important for MVAΔE5R-induced type I IFN production, pDCs were sorted from Flt3L-cultured BMDCs ($B220^+PDCA\text{-}1^+$) obtained from WT, $cGAS^{-/-}$, or $MyD88^{-/-}$ mice. $2\times10^5$ cells were infected with either MVA or MVAΔE5R. No treatment (NT) control was included. Supernatants were collected at 18 h post infection. IFN-β levels in the supernatants were measured by ELISA. The results show that MVAΔE5R-induced IFN-β production was abolished in $cGAS^{-/-}$ Flt3L-pDCs and was largely unchanged in $MyD88^{-/-}$ Flt3L-pDCs (FIG. 68).

Example 69: MVAΔE5R-induced IFN-β protein secretion from $CD103^+$ DCs is dependent on cGAS.

Figure 69:
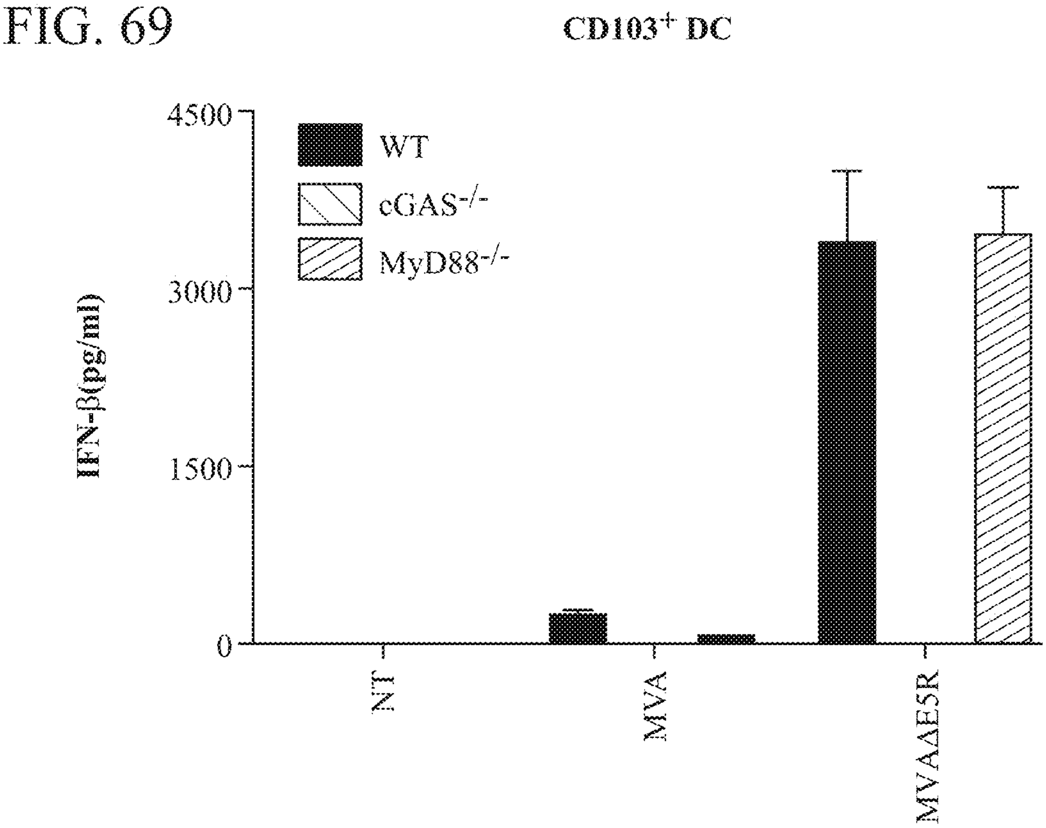
FIG. 69 shows that MVAΔE5R infection induces IFN-β protein secretion from $CD103^+$ DCs through a cGAS-dependent pathway. $CD103^+$ DCs were sorted from Flt3L-cultured BMDCs ($CD11c^+CD103^+$) obtained from WT, $cGAS^{-/-}$, or $MyD88^{-/-}$ mice. $2+10^5$ cells were infected with either MVA or MVAΔE5R. NT control was included. Supernatants were collected at 18 h post infection. IFN-β levels in the supernatants were measured by ELISA.

$CD103^+$ DCs are a subset of conventional DCs important for cross-presenting antigens. Transcription factor Batf3 is important for the development of $CD103^+$ DCs. $CD103^+$ DCs are critical for cross-presenting tumor antigens and initiate antitumor immunity. To test whether MVAΔE5R induces IFN-β protein secretion from sorted Flt3L-$CD103^+$ DCs and whether cGAS or MyD88 is important for the induction, $CD103^+$ DCs were sorted from Flt3L-cultured BMDCs ($CD11c^+CD103^+$) obtained from WT, $cGAS^{-/-}$, or $MyD88^{-/-}$ mice. $2\times10^5$ cells were infected with either MVA or MVAΔE5R. NT control was included. Supernatants were collected at 18 h post infection. IFN-β levels in the supernatants were measured by ELISA. The results show that MVAΔE5R potently induce IFN-β protein secretion from sorted Flt3L-$CD103^+$ DCs. The IFN-β concentration in the supernatants from MVAΔE5R-infected $CD103^+$DCs was 3610 pg/ml, whereas the IFN-β concentration in the supernatants from MVA-infected $CD103^+$DCs was 365.5 pg/ml (FIG. 69). Furthermore, the induction of IFN-β protein secretion from sorted Flt3L-$CD103^+$ DCs by MVAΔE5R is completely dependent on cGAS and MyD88 is not required for the induction effect (FIG. 69).

Example 70: MVAΔE5R infection of BMDCs results in lower levels of cell death compared with MVA.

Figure 70:
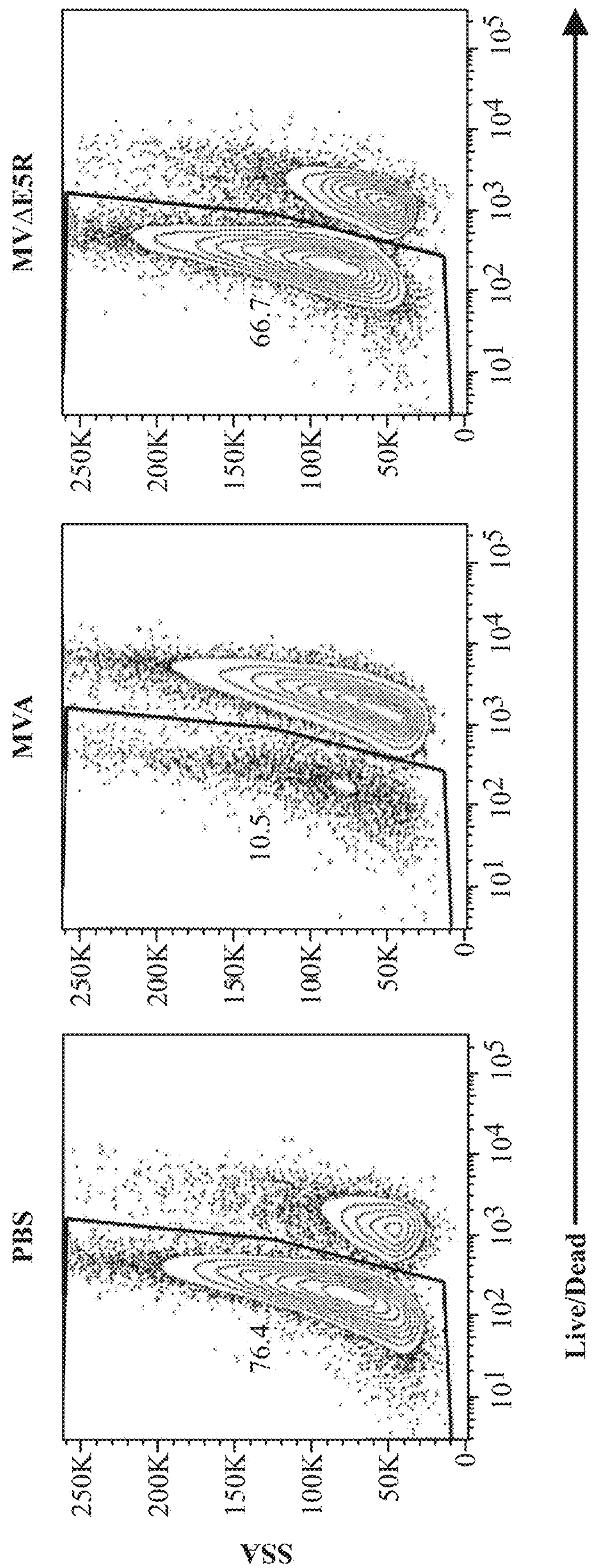
FIG. 70 shows that MVAΔE5R infection of BMDCs results in lower levels of cell death compared with MVA. BMDCs were infected with either MVA or MVAΔE5R at a MOI of 10. Cells were harvested at 16 h post infection and stained with LIVE/DEAD fixable viability dye and subjected for flow cytometry analysis.

To quantify the fraction of MVAΔE5R-infected BMDCs that were alive after several days of culture with regular medium compared to MVA-infected BMDCs, BMDCs were infected with either MVA or MVAΔE5R at a MOI of 10. Cells were harvested at 16 h post infection and stained with LIVE/DEAD fixable viability dye and subjected for flow cytometry analysis. FACS results show that whereas 76.4% of PBS-mock infected BMDCs were alive, only 10.5% of BMDCs infected with MVA were alive. By contrast, 66.7% of BMDCs infected with MVAΔE5R were alive at 16 h post infection (FIG. 70).

Example 71: MVAΔE5R infection promotes DC maturation in a cGAS-dependent manner.

Figure 71A:
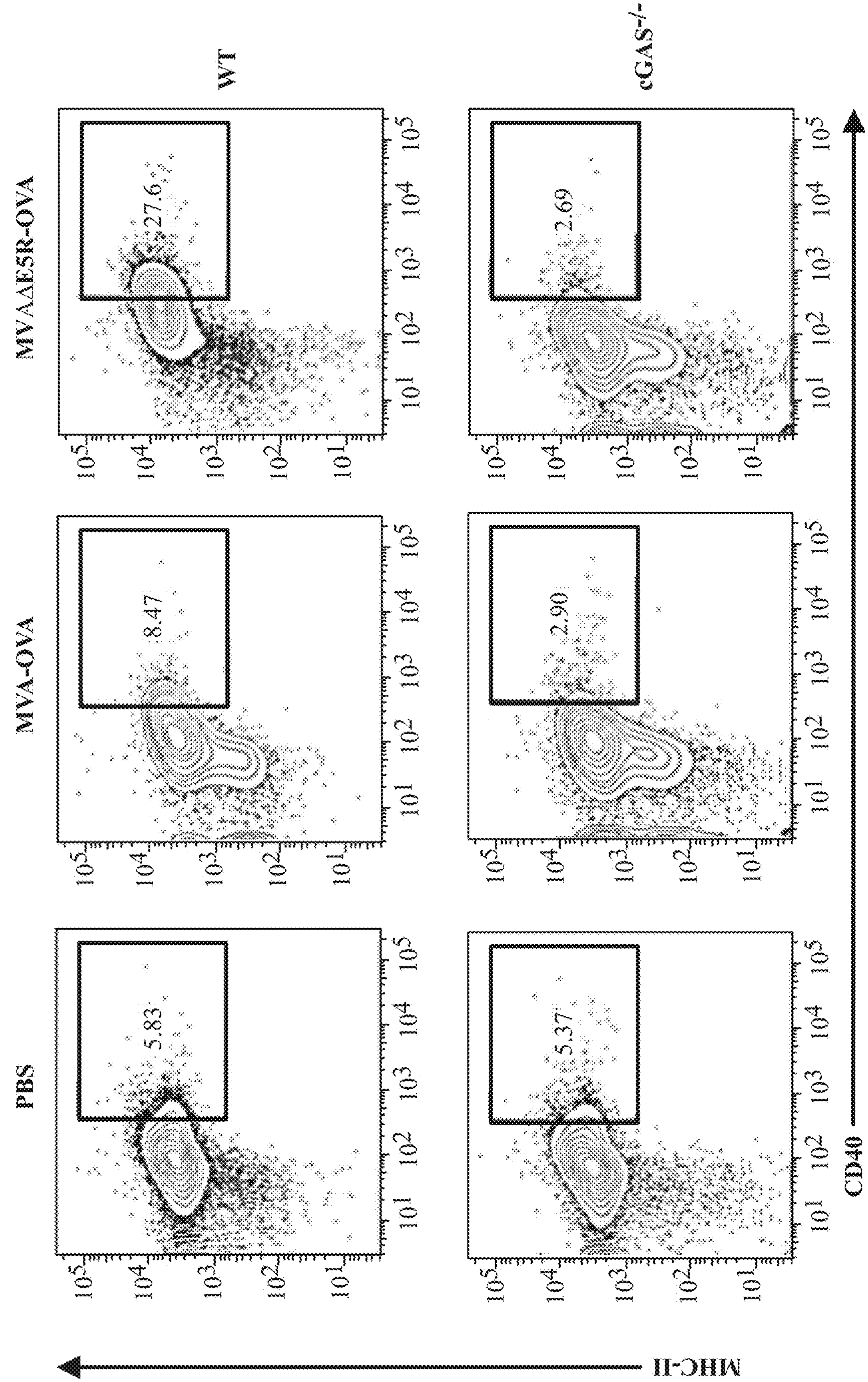
FIGS. 71A and 71B show that MVAΔE5R infection promotes DC maturation in a cGAS-dependent manner. BMDCs from WT and $cGAS^{-/-}$ mice were infected with MVA-OVA or MVAΔE5R-OVA at MOI of 10. Cells were collected at 16 h post infection and stained for DC maturation markers: CD40 (FIG. 71A) and CD86 (FIG. 71B).
Figure 71B:
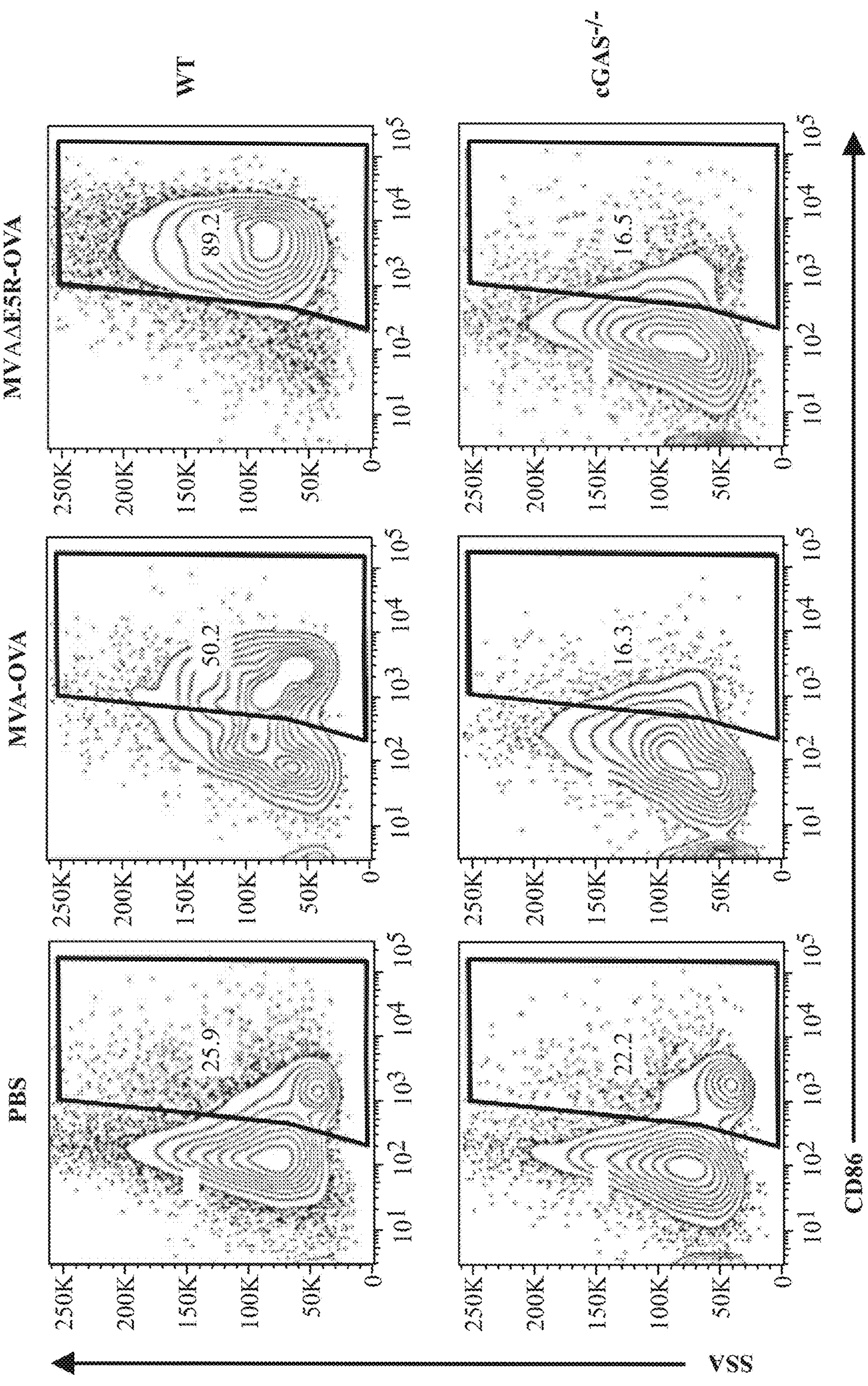
Figure 72A:
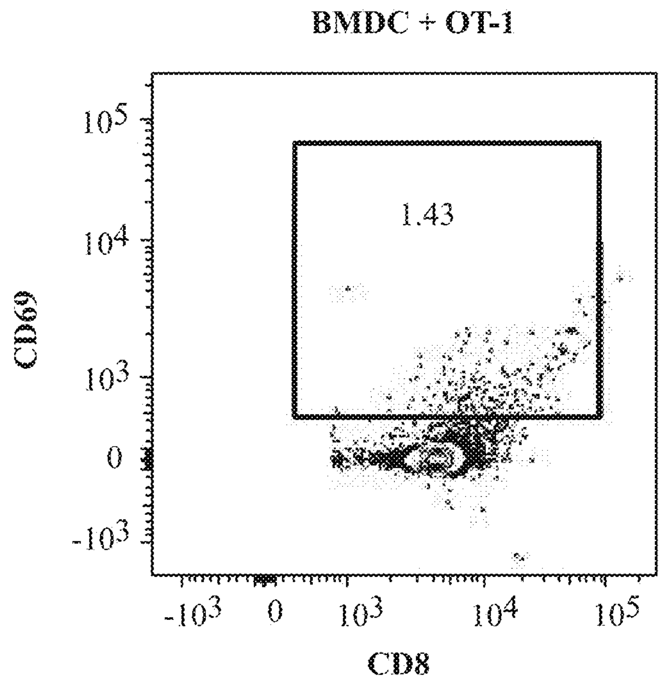
FIGS. 72A-72G shows that MVAΔE5R infection of BMDCs promotes antigen cross-presentation as measured by T cell activation. BMDCs were infected with either MVA, MVAΔE5R, Heat-iMVA, or Heat-iMVAΔE5R at MOI of 3 for 3 h and then incubated with OVA for 3 h. OVA was washed away and cells were then incubated with OT-I cells (which recognizes $OVA_{257-264}$ SIINFEKL peptide) for 3 days. OT-1 cells were stained with anti-CD69 and anti-CD8 antibodies and analyzed by flow cytometry. Supernatants were collected and IFN-γ levels were determined by ELISA. Dot plots demonstrate $CD8^+$ cells expressing CD69.
Figure 72B:
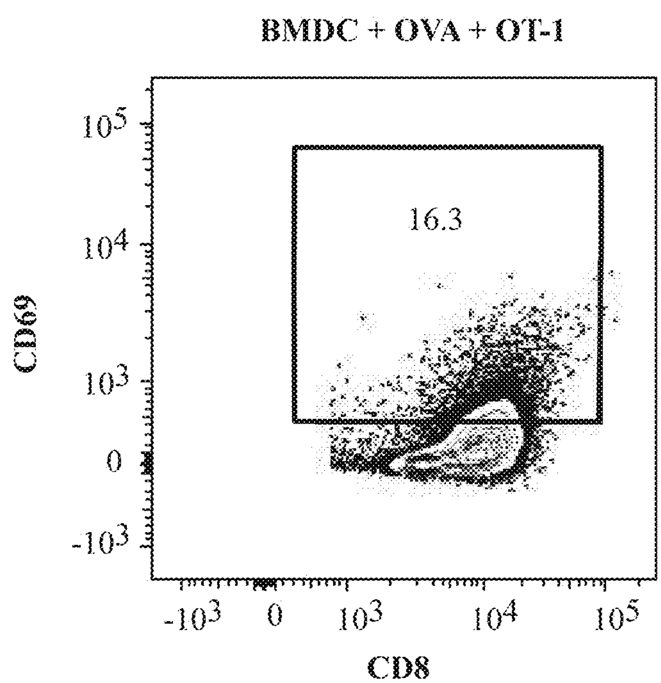
Figure 72C:
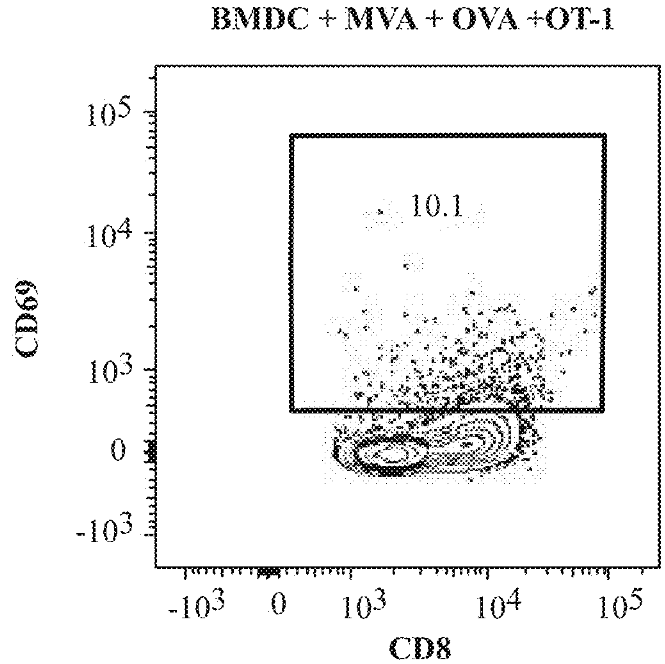
Figure 72D:
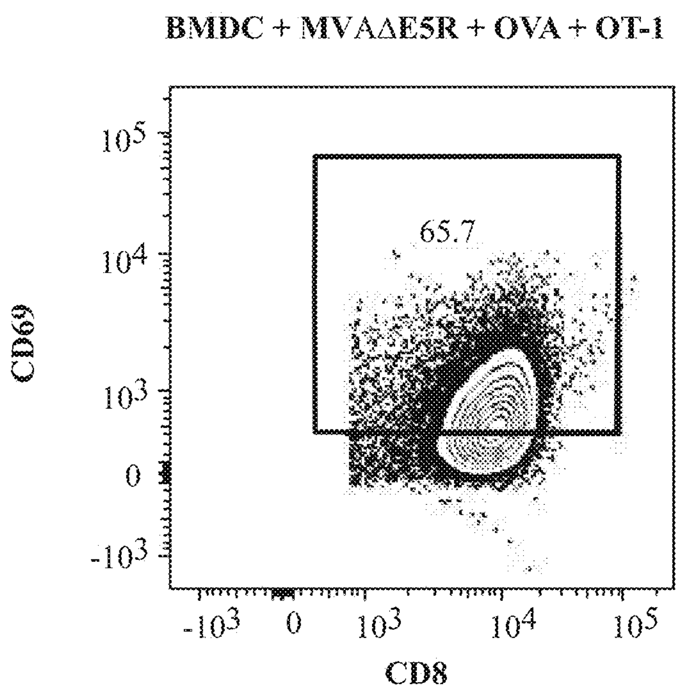
Figure 72E:
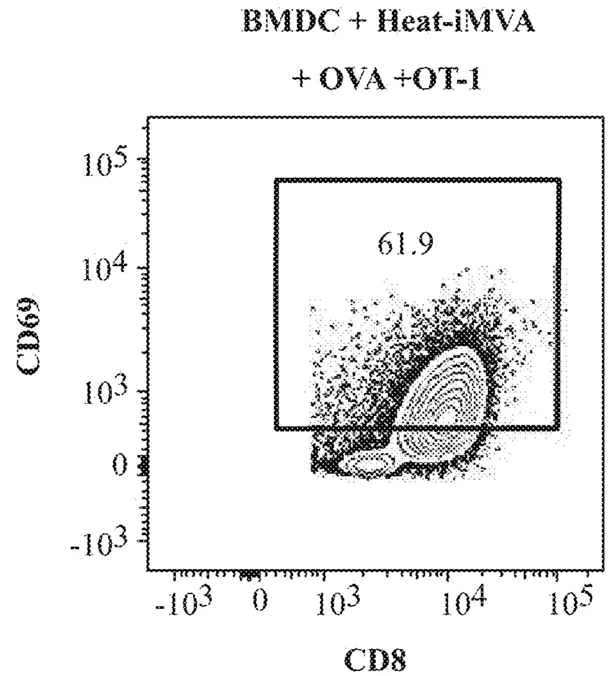
Figure 72F:
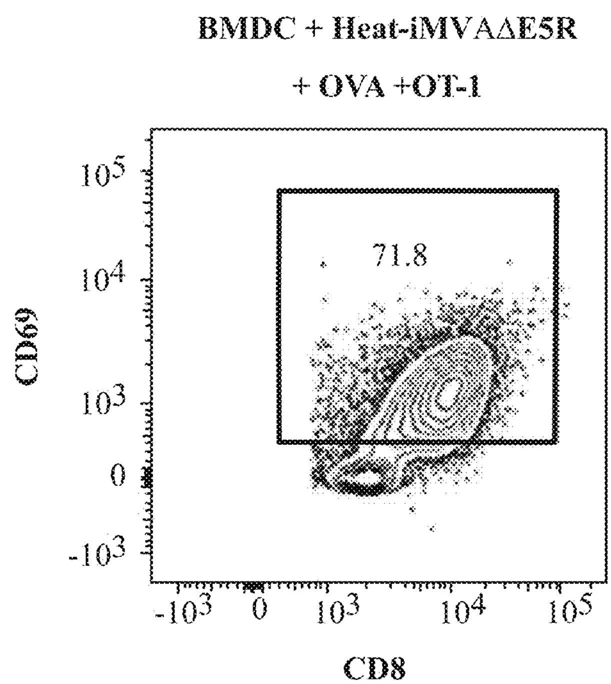
Figure 72G:
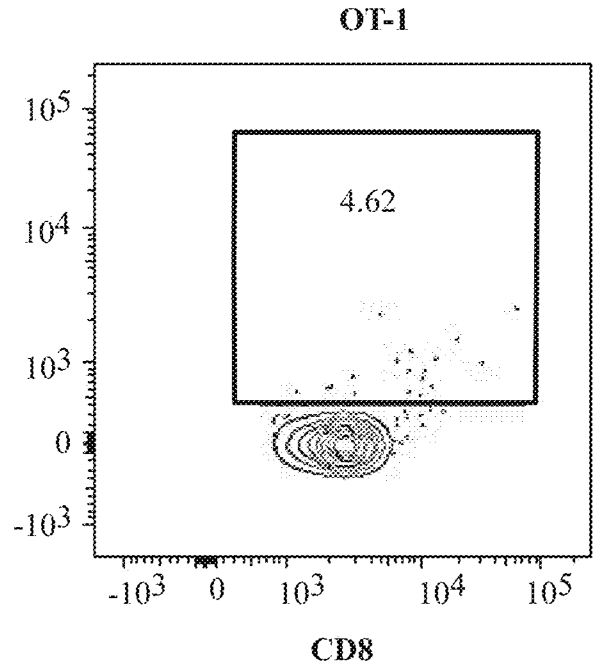

It is known that that BMDCs infected with MVAΔE5R exhibit an activated phenotype, with extension of dendrites. CD40 and CD86 are two known DC activation markers. To determine whether MVAΔE5R infection induces DC activation, and whether DC maturation occurs via a cGAS-dependent mechanism, BMDCs from WT and $cGAS^{-/-}$ mice were either mock infected or infected with MVA-OVA or MVAΔE5R-OVA at MOI of 10. Cells were collected at 16 h post infection and stained for DC maturation markers: CD40 (FIG. 71A) and CD86 (FIG. 71B). BMDCs express high levels of MHCII. Upon MVAΔE5R-OVA infection, CD40 was upregulated on WT BMDCs, but not in $cGAS^{-/-}$ BMDCs (FIG. 71A). MVAΔE5R-OVA infection of BMDCs strongly upregulated CD86 expression on WT BMDCs, but not in cGAS$^{-/-}$ BMDCs. 89.2% of WT BMDCs were CD86$^+$ after MVAΔE5R infection, whereas only 16.5% of cGAS$^{-/-}$ BMDCs were CD86$^+$ after MVAΔE5R infection. MVA infection in WT BMDCs resulted in 50.2% CD86$^+$ BMDCs, but only 16.3% CD86$^+$ cGAS$^{-/-}$ BMDCs (FIG. 71B). These results demonstrate that MVAΔE5R infection of BMDCs induces DC maturation, as manifested as upregulation of maturation markers, including CD40 and CD86, in a cGAS-dependent manner.

Example 72: MVAΔE5R infection of BMDCs promotes antigen cross-presentation as measured by T cell activation.

To test the functional significance of BMDC activation induced by MVA, MVAΔE5R, Heat-iMVA, or Heat-iMVAΔE5R, BMDCs were infected with either MVA, MVAΔE5R, Heat-iMVA, or Heat-iMVAΔE5R at MOI of 3 for 3 h and then incubated with chicken ovalbumin (OVA) for 3 h. The OVA protein was washed away and cells were then incubated with OT-I cells (which recognizes $OVA_{257-264}$ SIINFEKL peptide) for 3 days. The BMDC: OT-1 cell ratio was 1:1. OT-1 cells were stained with anti-CD69 and anti-CD8 antibodies and analyzed by flow cytometry. Dot plots demonstrate CD8$^+$ cells expressing CD69 (FIGS. 72A-72G). The results show that MVAΔE5R-infected OVA-pulsed BMDCs: OT-1 T cell co-culture lead to 65.7% CD69$^+$CD8$^+$ T cells, whereas MVA-infected OVA-pulsed BMDCs: OT-1 T cell co-culture resulted in 10.1% CD69$^+$ CD8$^+$ T cells. Heat-iMVA or Heat-iMVAΔE5R infection of BMDCs also resulted in activation of OT-1 T cells in the OVA-pulsed BMDC: OT-1 T cell co-culture. These results demonstrate that MVAΔE5R, Heat-iMVA, or Heat-iMVAΔE5R infection of BMDCs promotes antigen cross-presentation by BMDCs.

Example 73: MVAΔE5R infection of BMDCs promotes antigen cross-presentation as measured by IFN-γ production by activated T cells.

Figure 73:
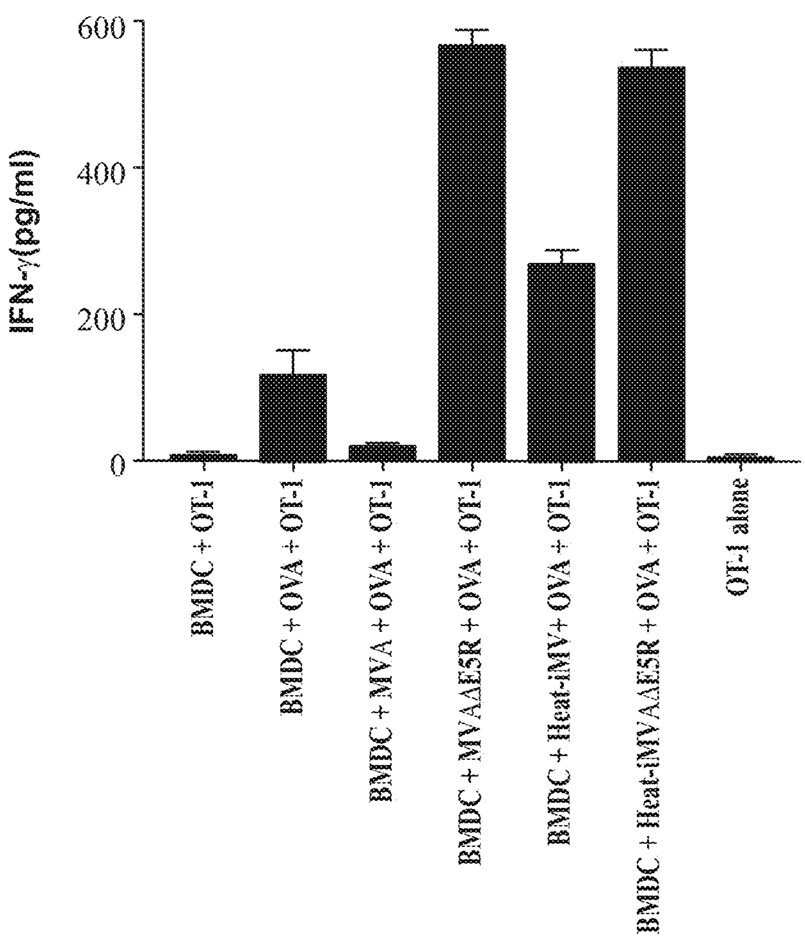
FIG. 73 shows that MVAΔE5R infection of BMDCs promotes antigen cross-presentation as measured by IFN-γ production by activated T cells. BMDCs were infected with either MVA, MVAΔE5R, Heat-iMVA, or Heat-iMVAΔE5R at MOI of 3 for 3 h and then incubated with OVA for 3 h. OVA was washed away and cells were then incubated with OT-I cells (which recognizes $OVA_{257-264}$ SIINFEKL peptide) for 3 days. OT-1 cells were stained with anti-CD69 and anti-CD8 antibodies and analyzed by flow cytometry. Supernatants were collected and IFN-γ levels were determined by ELISA.

Supernatants were collected at the end of the 3 day BMDC: OT-1 T cell co-culture in the experiment outlined in Example 72. IFN-γ levels in the supernatants were determined by ELISA. The results demonstrate that either MVAΔE5R or Heat-iMVAΔE5R-infected OVA-pulsed BMDC: OT-1 T cell co-cultures generated high levels of IFN-γ protein in the supernatants (FIG. 73). These results indicate MVAΔE5R or Heat-iMVAΔE5R infection of BMDCs promotes antigen cross-presentation by BMDCs.

Example 74: VACVΔE5R infection of BMDCs promotes antigen cross-presentation as measured by IFN-γ production by activated T cells.

Figure 74:
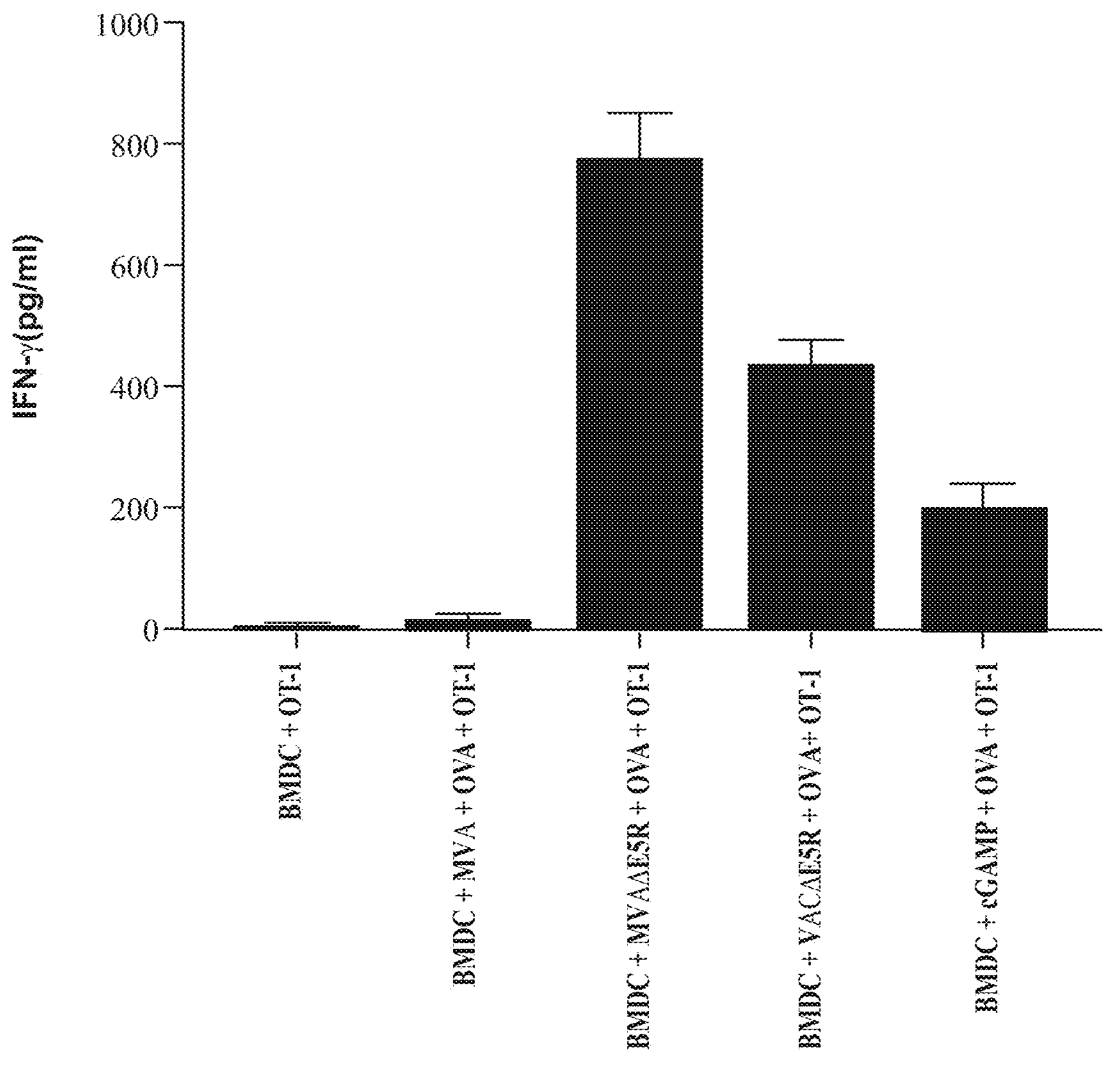
FIG. 74 shows that VACVΔE5R infection of BMDCs promotes antigen cross-presentation as measured by IFN-γ production by activated T cells. BMDCs were infected with either MVA, MVAΔE5R, or VACVΔE5R at MOI of 3 for 3 h; or BMDCs were incubated with cGAMP or mock control for 3 h. BMDCs were subsequently incubated with OVA for 3 h and then the OVA was washed away. Cells were then incubated with OT-I cells (which recognizes OVA257-264 SIINFEKL peptide) for 3 days. Supernatants were collected and IFN-γ levels were determined by ELISA.

It was previously observed that VACVΔE5R infection of BMDCs induces higher levels of IFNB gene expression and IFN-β protein production than MVA (FIGS. 56A and 56B). To determine whether VACVΔE5R infection of BMDCs promotes antigen cross-presentation, the inventors performed the following experiment. Briefly, BMDCs were infected with either MVA, MVAΔE5R, or VACVΔE5R at MOI of 3 for 3 h; or BMDCs were incubated with cGAMP (20 μM) or mock control for 3 h. BMDCs were subsequently incubated with OVA for 3 h and then the OVA protein was washed away. Cells were then incubated with OT-I cells (which recognizes $OVA_{257-264}$ SIINFEKL peptide) for 3 days. Supernatants were collected and IFN-γ levels were determined by ELISA (FIG. 74). The results demonstrate that MVAΔE5R-infected OVA-pulsed BMDC: OT-1 T cell co-culture generated highest level of IFN-γ in the supernatants. VACVΔE5R-infected OVA-pulsed BMDC: OT-1 T cell co-culture secreted higher level of IFN-γ compared with cGAMP-treated OVA-pulsed BMDC: OT-1 T cell co-culture. These results indicate that VACVΔE5R infection of BMDCs also promotes antigen cross-presentation.

Example 75: Deletion of the E5R gene from MVA genome improves vaccination efficacy.

MVA is an important and safe vaccine vector. Given that MVA has modest induction of IFN-β secretion from BMDCs and modest activation effects on DC maturation, identification of immune suppressive mechanism can lead to improvement of MVA-based vaccine vector design. To test whether deletion of the E5R gene from MVA improves vaccination efficacy, the inventors performed the following experiment. Briefly, on day 0, C57BL/6J mice were vaccinated with MVA-OVA or MVAΔE5R-OVA at $2\times10^7$ pfu either through skin scarification or intradermal injection (FIG. 75A). Spleens were harvested from euthanized mice one week later and co-cultured with $OVA_{257-264}$ (SIINFEKL) peptide (10 μg/ml) pulsed BMDCs for 12 h. The intracellular IFN-γ levels in CD8$^+$ T cells was then measured by flow cytometry. (* $p<0.05$;  $p<0.01$). FIG. 75B shows activated CD8$^+$ T cells after vaccination through skin scarification with MVA-OVA or MVAΔE5R-OVA. FIG. 75**C shows activated CD8$^+$ T cells after vaccination through intradermal injection of MVA-OVA or MVAΔE5R-OVA. These results demonstrate that vaccination with MVAΔE5R-OVA either through skin scarification or intradermal injection leads to higher activated CD8$^+$ T cells compared with vaccination with MVA-OVA. Therefore, removing the E5R gene from MVA genome improves vaccination efficacy.

Example 76: MVAΔE5R infection induces IFNB gene expression and IFN-secretion from murine primary fibroblasts in a cGAS-dependent manner.

Figure 76A:
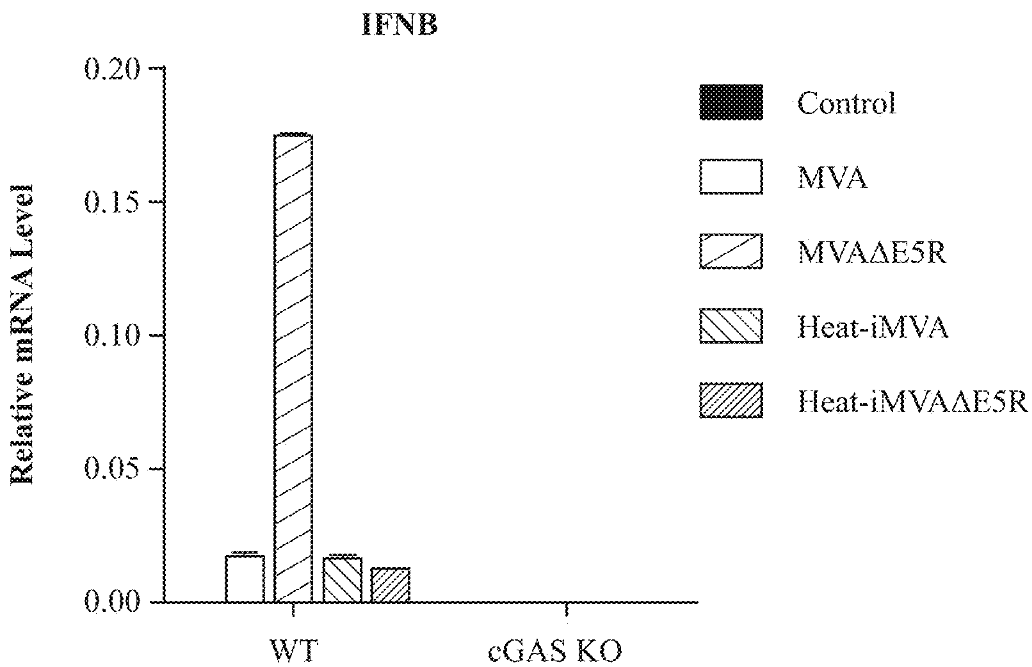
FIGS. 76A and 76B show that MVAΔE5R infection induces IFNB gene expression and IFN-β secretion from murine primary fibroblasts in a cGAS-dependent manner. Skin dermal fibroblasts were generated from female WT and $cGAS^{-/-}$ C57BL/6J mice. Cells were infected with either MVA, MVAΔE5R, Heat-iMVA, or Heat-iMVAΔE5R. Cells and supernatants were collected at 16 h post infection.
Figure 76B:
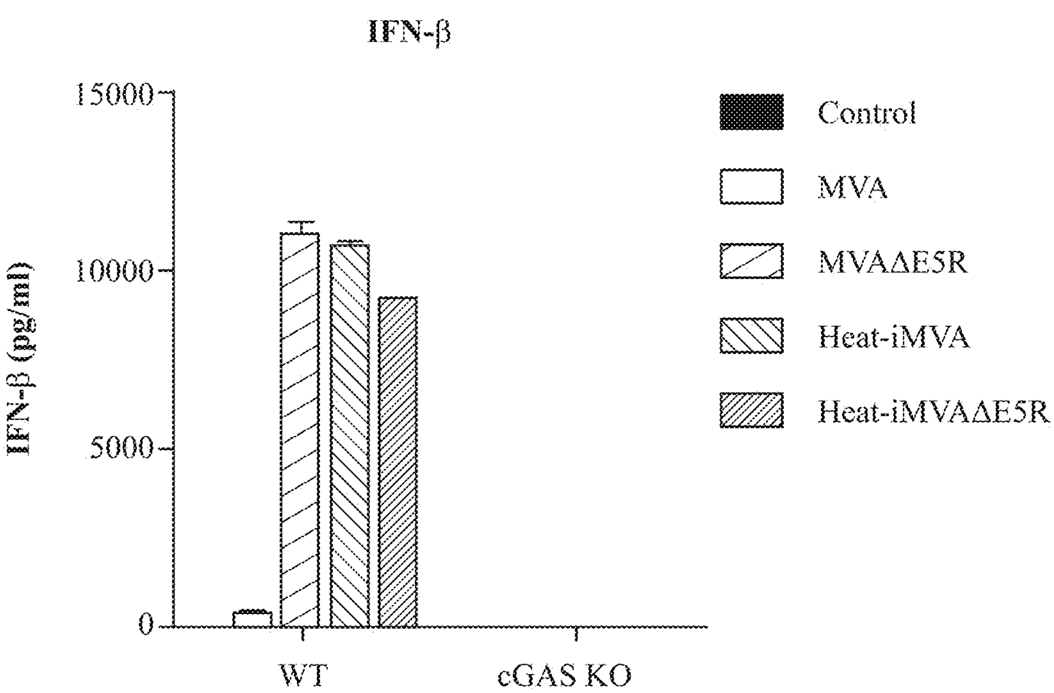

In addition to dendritic cells and macrophages, the inventors investigated whether MVAΔE5R infection of skin dermal fibroblasts also induce type I IFN production. Skin dermal fibroblasts were generated from female WT and cGAS$^{-/-}$ C57BL/6J mice. Cells were infected with either MVA, MVAΔE5R, Heat-iMVA, or Heat-iMVAΔE5R. Cells and supernatants were collected at 16 h post infection. RT-PCR results showed that MVAΔE5R infection triggered IFNB gene expression in WT dermal fibroblasts but not in cGAS$^{-/-}$ cells (FIG.76A). ELISA results demonstrated MVAΔE5R induced IFN-β protein secretion from MVAΔE5R-infected WT dermal fibroblasts but not in infected cGAS$^+$ cells (FIG. 76B). By contrast, MVA infection of WT induced lower level of IFN-β protein secretion from WT dermal fibroblasts (FIG. 76B). The IFN-β protein concentration in the supernatants of MVA-infected WT dermal fibroblasts was 350 pg/ml, compared with 10970 pg/ml in the supernatants of MVAΔE5R-infected WT dermal fibroblasts. These results demonstrate that E5 is a potent inhibitor of IFN production in MVA-infected dermal fibroblasts, and MVAΔE5R generates strong immune activating effect on skin dermal fibroblasts. This immune activating effect is likely to contribute to its enhanced vaccine efficacy through skin scarification or intradermal infection. In addition, MVAΔE5R is likely to activate tumor stromal cells or cancer-associated fibroblasts through similar mechanisms, which would contribute to its effect on altering tumor-immune suppressive microenvironment.

Example 77: MVAΔE5R gains its capacity to replicate its DNA in cGAS-or IFNAR1-deficient skin primary dermal fibroblasts.

To test whether cGAS or IFNAR1contribute to host restriction of MVA or MVAΔE5R virus in skin dermal fibroblasts, skin primary dermal fibroblasts from WT, $cGAS^{-/-}$ or $IFNAR1^{-/-}$ mice were infected with either MVA or MVAΔE5R at a MOI of 3. Cells were collected 1, 4, 10 and 24 h post infection. Viral DNA copy numbers were determined by quantitative PCR. Although MVA has limited capacity of replicating viral genome in WT dermal fibroblasts, its replication capacity increased dramatically in $cGAS^{-/-}$ cells and modestly in $IFNAR1^{-/-}$ cells (FIGS. 77A and 77B). For example, MVA DNA copy number increased from 2-fold at 4 h, to 28-fold at 10 h, and to 41-fold at 24 h post infection compared with that at 1 h post infection in WT dermal fibroblasts. In $cGAS^{-/-}$ cells, MVA DNA copy number increased from 8-fold at 4 h, to 120-fold at 10 h, and to 390-fold at 24 h post infection compared with that at 1 h post infection. In $IFNAR1^{+}$ cells, MVA DNA copy number increased from 5-fold at 4 h, to 50-fold at 10 h, and to 107-fold at 24 h post infection compared with that at 1 h post infection (FIGS. 77A and 77B).

Similarly, in WT dermal fibroblasts, MVAΔE5R DNA copy number increased from 1-fold at 4 h, to 18-fold at 10 h, and 21-fold at 24 h post infection compared with that at 1 h post infection. In $cGAS^{-/-}$ cells, MVAΔE5R DNA copy number increased from 1.8-fold at 4 h, to 87-fold at 10 h, and to 832-fold at 24 h post infection compared with that at 1 h post infection. In $IFNAR1^{-/-}$ cells, MVAΔE5R DNA copy number increased from 1.9-fold at 4 h, to 57-fold at 10 h, and to 181-fold at 24 h post infection compared with that at 1 h post infection (FIGS. 77C and 77D). These results demonstrate that the cGAS-mediated sensing mechanism in dermal fibroblasts was critical in controlling MVA and MVAΔE5R viral DNA replication, and the IFNAR-mediated type I IFN positive feedback loop plays a partial role.

Example 78: MVAΔE5R gains its capacity to generate infectious progeny viruses in cGAS-deficient skin primary dermal fibroblasts.

Figure 78A:
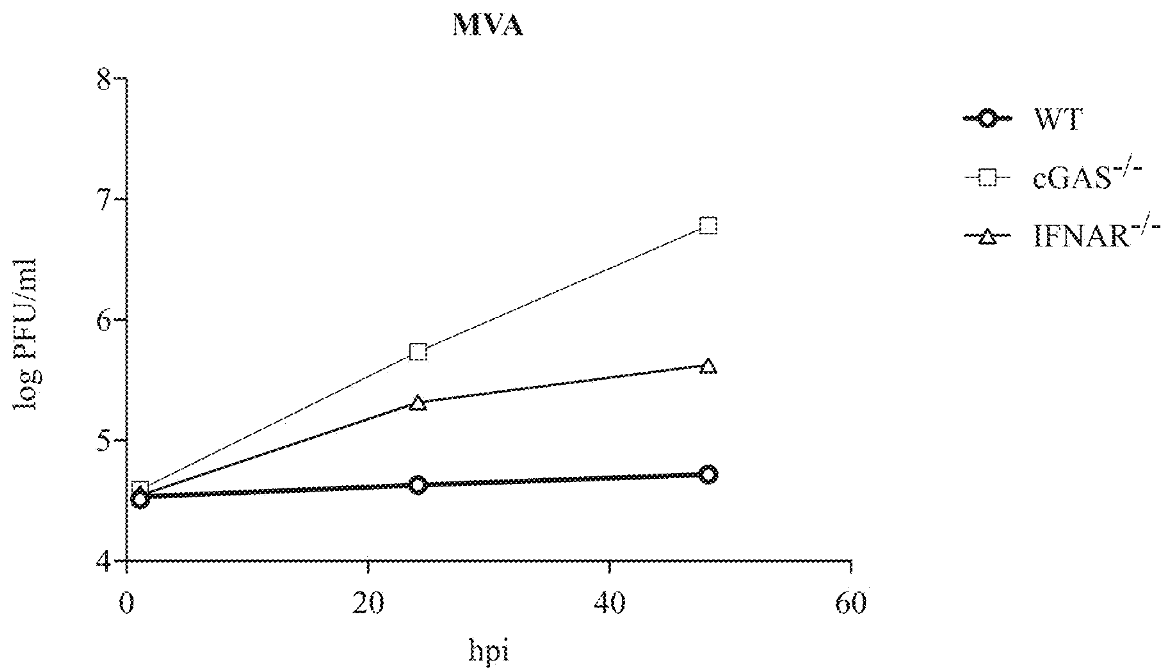
FIGS. 78A-78D show that MVAΔE5R gains its capacity to generate infectious progeny viruses in cGAS-deficient skin primary dermal fibroblasts. Skin primary dermal fibroblasts from WT, $cGAS^{-/-}$ or $IFNAR1^{-/-}$-mice were infected with either MVA or MVAΔE5R at a MOI of 0.05. Cells were collected 1, 24, and 48 h post infection. Viral titers were determined by titrating on BHK21 cells.
Figure 78B:
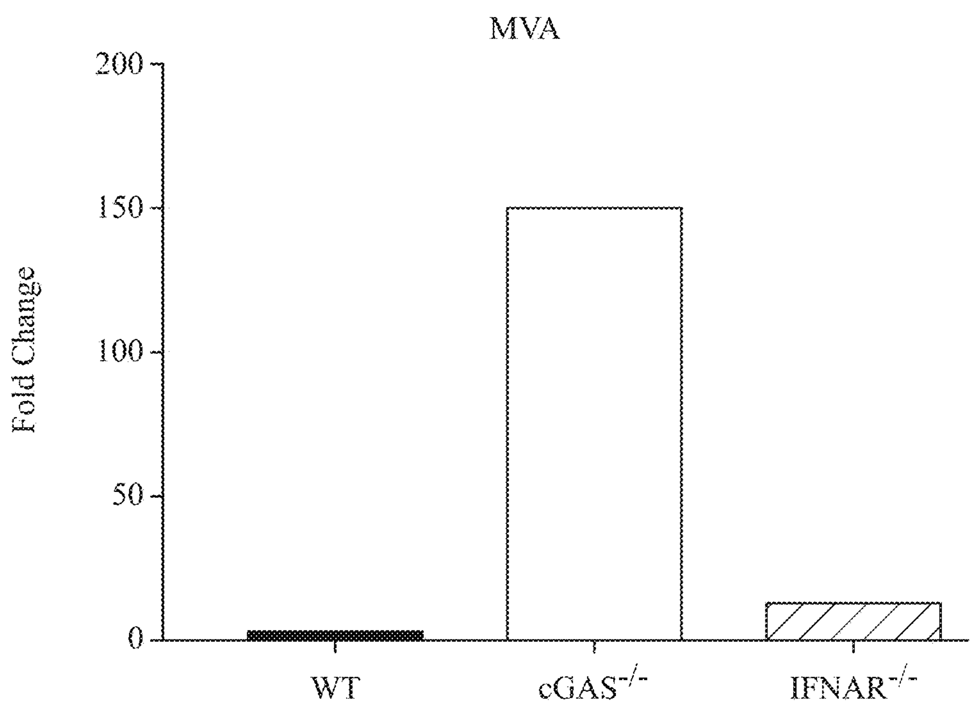
Figure 78C:
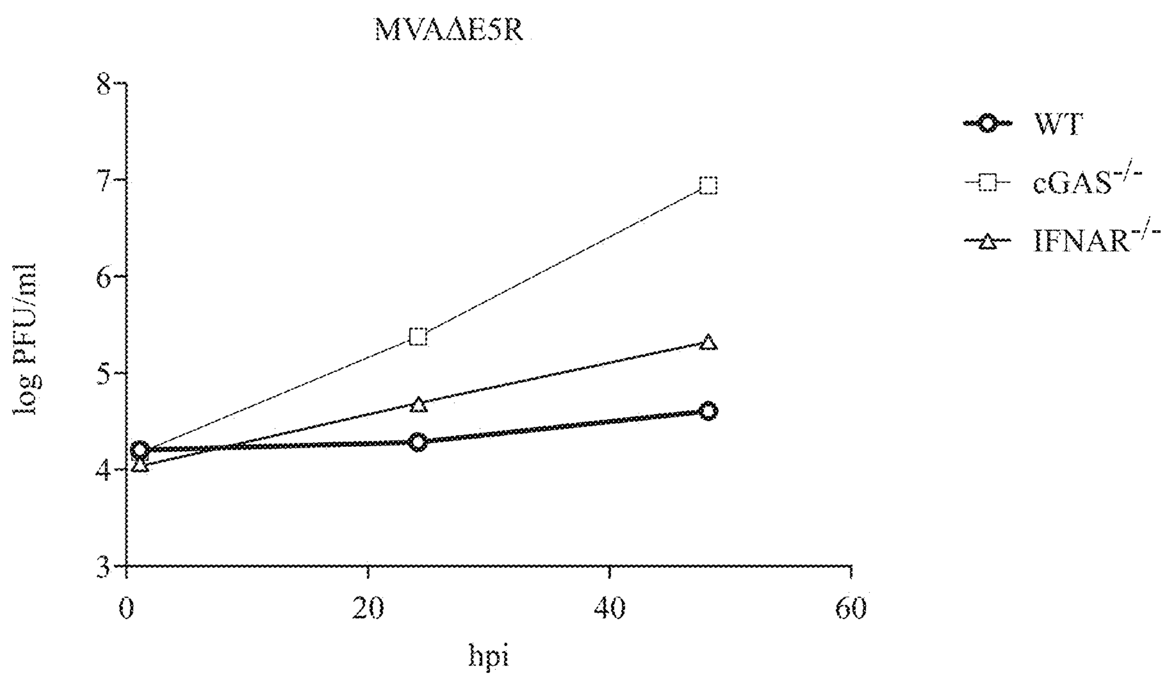
Figure 78D:
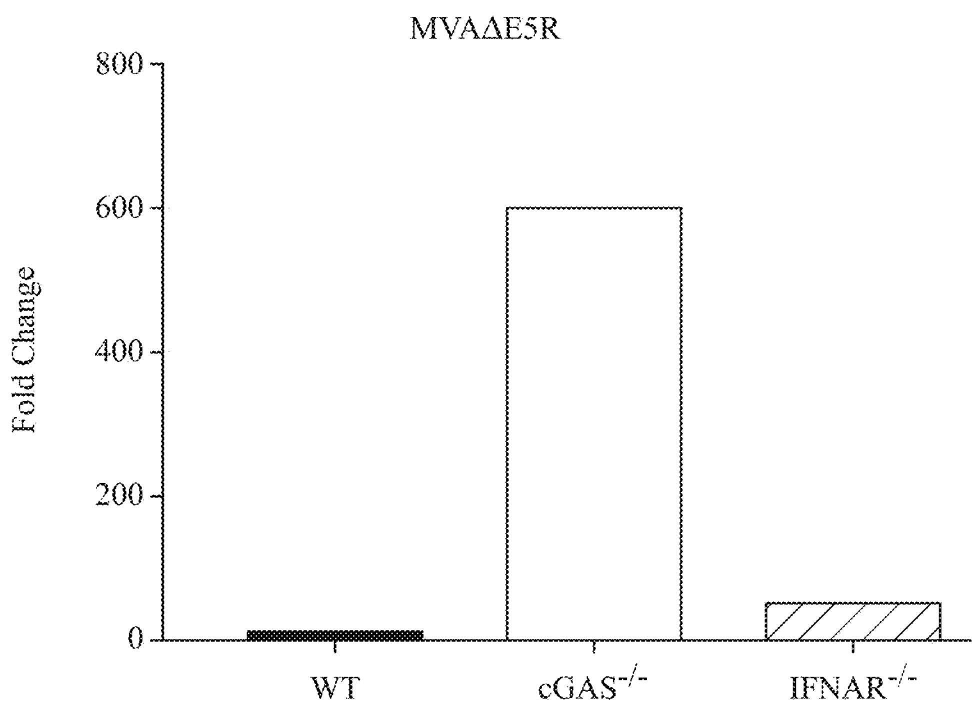

MVA is non-replicative in dermal fibroblasts. To determine whether the cGAS-mediated cytosolic DNA-sensing pathway and the IFANR pathway play a role in restricting the production of infectious virions, skin primary dermal fibroblasts from WT, $cGAS^{-/-}$ or $IFNAR1^{-/-}$ mice were infected with either MVA or MVAΔE5R at a MOI of 0.05. Cells were collected 1, 24, and 48 h post infection. Viral titers were determined by titrating on BHK21 cells. In WT dermal fibroblasts, both MVA and MVAΔE5R are non-replicative. However, in $cGAS^{-/-}$ cells, MVA titers at 48 h post infection increased by 148-fold compared with its titers at 1 h post infection (FIGS. 78A and 78B). More strikingly, MVAΔE5R titers at 48 h post infection increased by 583-fold compared with its titers at 1 h post infection (FIGS. 78C and 78D). In $IFNAR1^{-/-}$ cells, MVA and MVAΔ5R increased their titers at 48 h post infection by 12- and 19-fold respectively compared with their titers at 1 h post infection (FIGS. 78A-77D). These results demonstrate that cGAS plays a critical role in restricting both MVA and MVAΔE5R replication in skin dermal fibroblasts.

Example 79: MVAΔE5R infection of murine melanoma cells induce IFNB gene expression and IFN-β protein secretion in a STING-dependent manner.

Figure 79A:
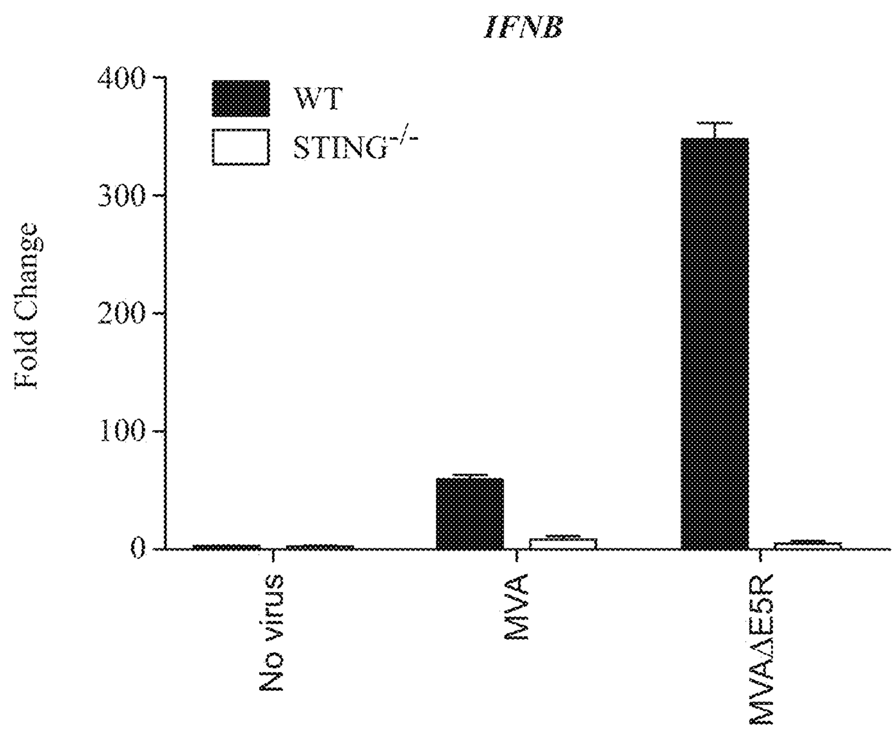
FIGS. 79A and 79B show that MVAΔE5R infection of murine melanoma cells induce IFNB gene expression and IFN-β protein secretion in a STING-dependent manner.
Figure 79B:
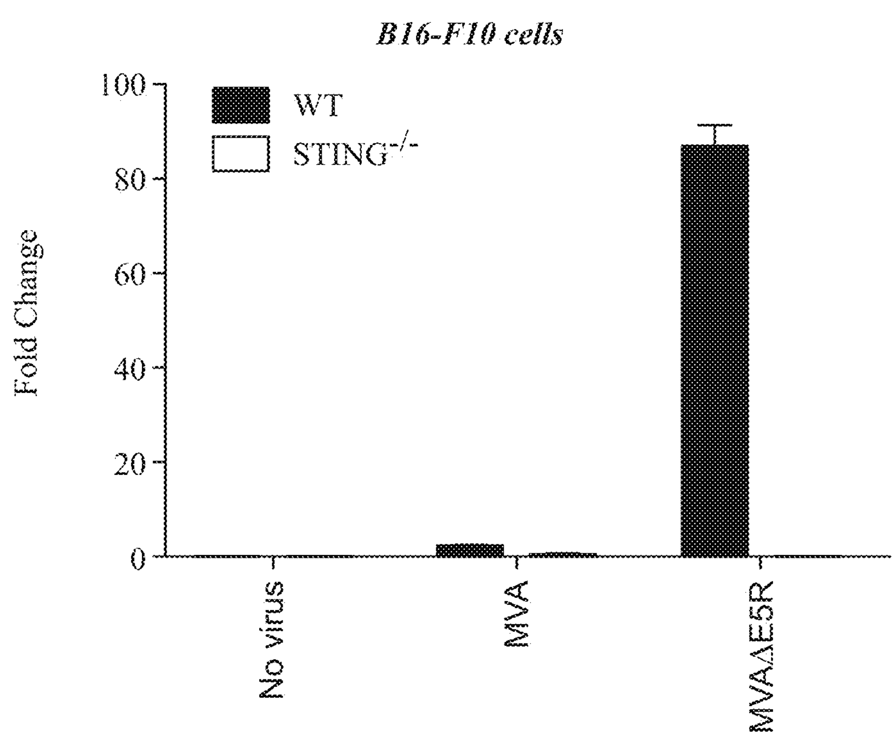

To determine whether MVAΔE5R infection of tumor cells induces IFNB gene expression and IFN-β protein secretion, WT and $STING^{-/-}$ B16-F10 cells (generated by CRISPR-cas9 gene targeting of STING) were infected with either MVA or MVAΔE5R at a MOI of 10. Cells were collected at 18 h post infection. RNAs were extracted and quantitative real-time PCR analysis was performed. The RT-PCR results demonstrate that MVAΔE5R induced IFNB gene expression in WT B16-F10 cells, but not in $STING^{-/-}$ cells. MVA infection demonstrated a weaker induction of IFNB gene expression compared with MVAΔE5R in WT B16-F10 cells (FIG. 79A). ELISA results of IFN-β protein levels in the supernatants of WT and $STING^{-/-}$ B16-F10 cells infected with either MVA or MVAΔE5R collected at 18 h post infection demonstrated MVAΔE5R induces modest level of IFN-β protein secretion from WT B16-F10 cells, but not in $STING^{-/-}$ cells (FIG. 79B). MVA infection did not result in IFN-β protein secretion (FIG. 79B).

Example 80: MVAΔE5R infection of murine melanoma cells induces ATP release, which is a hallmark of immunogenic cell death.

Figure 80:
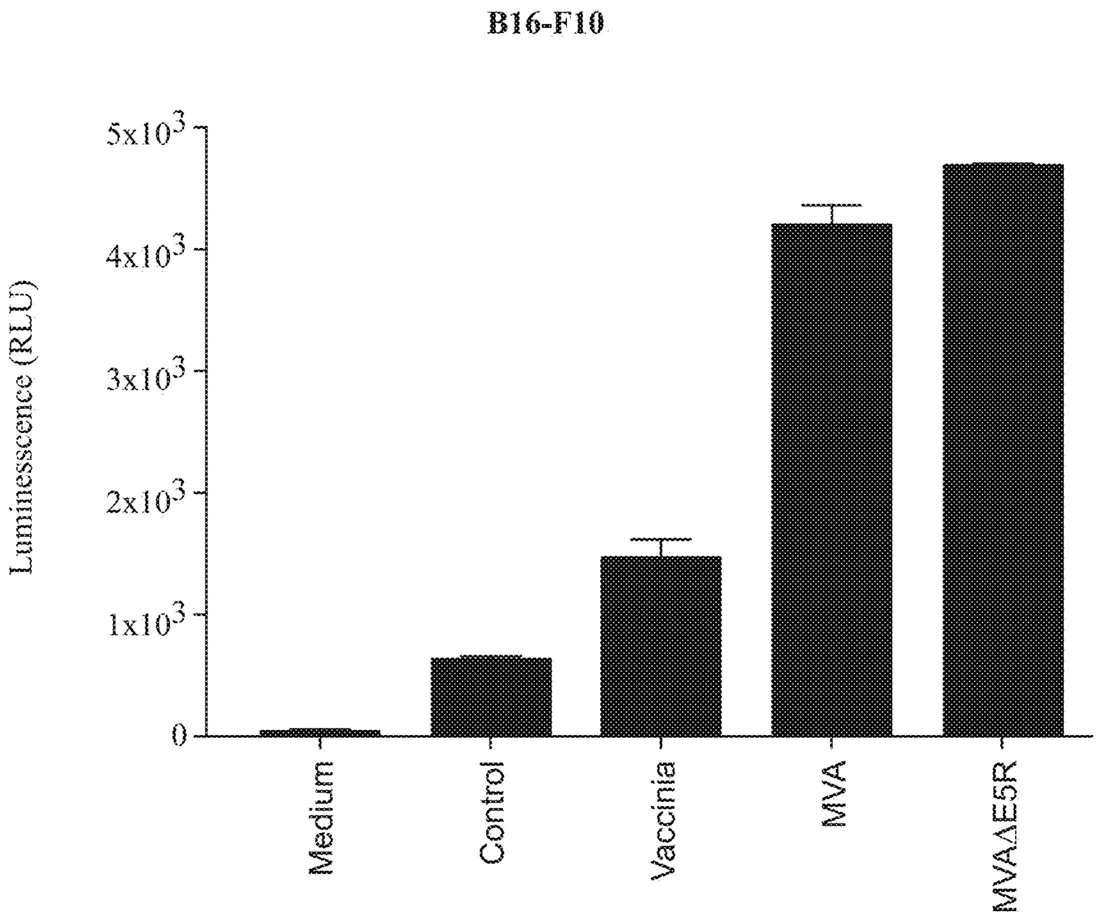
FIG. 80 shows that MVAΔE5R infection of murine melanoma cells induces ATP release, which is a hallmark of immunogenic cell death. B16-F10 cells were infected with WT vaccinia, MVA, or MVAΔE5R at a MOI of 10. Supernatants were collected at 48 h post infection. ATP levels were determined by using ATPlite 1step Luminescence ATP Detection Assay System (PerkinElmer, Waltham, MA).

FIG. 80 demonstrates that MVAΔE5R infection of murine melanoma cells induces ATP release, which is a hallmark of immunogenic cell death. Briefly, B16-F10 cells were infected with WT vaccinia, MVA, or MVAΔE5R at a MOI of 10. Cells were washed and fresh medium was added one hour after virus infection. Supernatants were collected at 48 h post infection. ATP levels were determined by using ATPlite Istep Luminescence ATP Detection Assay System (PerkinElmer, Waltham, MA). The results showed that MVA and MVAΔE5R infection of murine melanoma cells induced higher ATP release than vaccinia virus, which demonstrate that MVA and recombinant MVA induced immunogenic cell death in tumor cells. Future studies will examine whether MVA or MVAΔE5R infection of tumor cells also induce HMGB1 release, another hallmark of immunogenic cell death.

Example 81: Generation of recombinant MVAΔE5R expressing hFlt3L and hOX40L.

Figure 81:
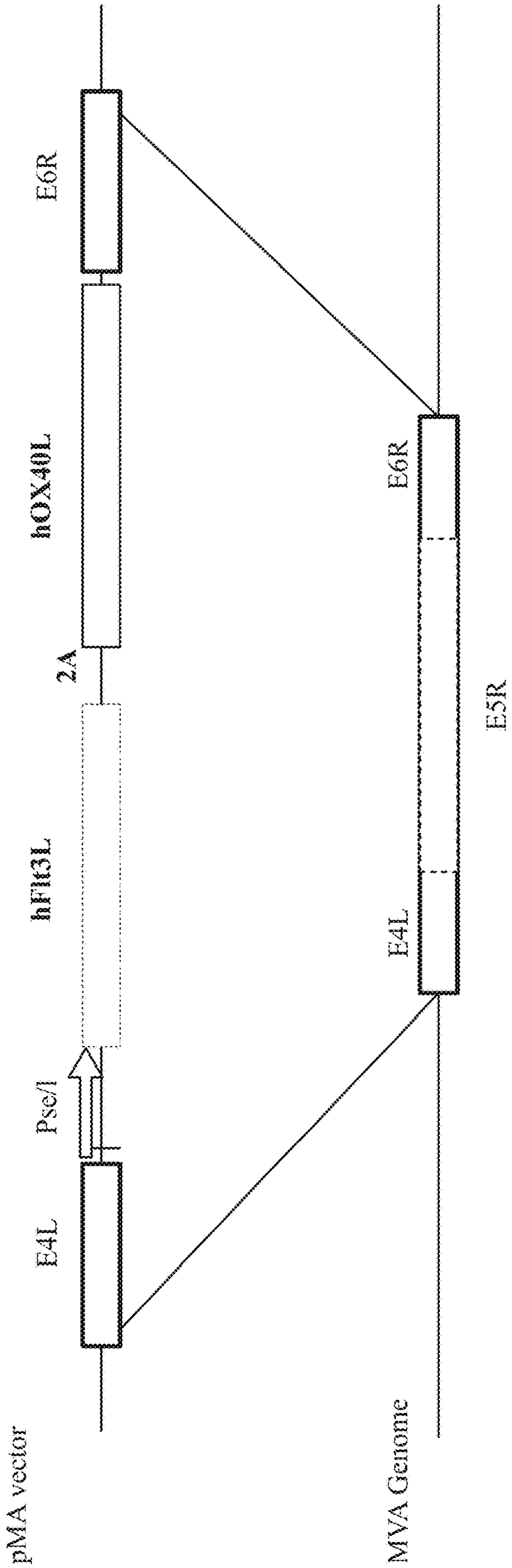
FIG. 81 shows a scheme of generating recombinant MVAΔE5R expressing hFlt3L and hOX40L through homologous recombination at the E4L and E6R loci of the MVA genome. pUC57 vector is used to insert a single expression cassette designed to express both hFlt3L and hOX40L using the vaccinia viral synthetic early and late promoter (PsE/L). The coding sequence of the hFl3L and hOX40L was separated by a cassette including a furin cleavage site followed by a Pep2A sequence. Homologous recombination that occurred at the E4L and E6R loci results in the insertion of expression cassette for hFlt3L and hOX40L.
Figure 82A:
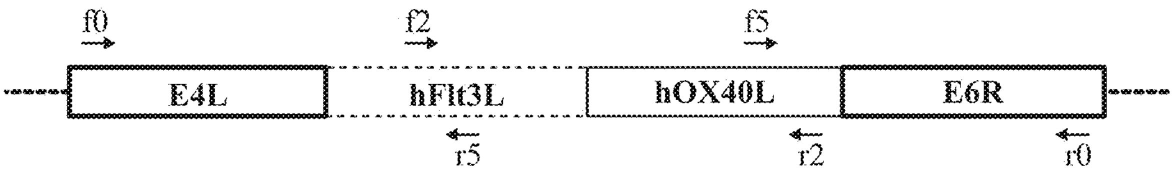
FIGS. 82A and 82B show that the recombinant MVAΔE5R-hFlt3L-hOX40LhOX40L virus has the expected insertion as determined by PCR analysis. Lane 1 shows the Fermentas 1 kb plus DNA ladder. Lane 2 shows a band with expected size of 1120 bp using F0/R5 primer pairs. Lane 3 shows a band with expected size of 1166 bp using F2/R2 primer pairs. Lane 4shows a band with expected size of 1136 bp using F5/R0 primer pairs.
Figure 82B:
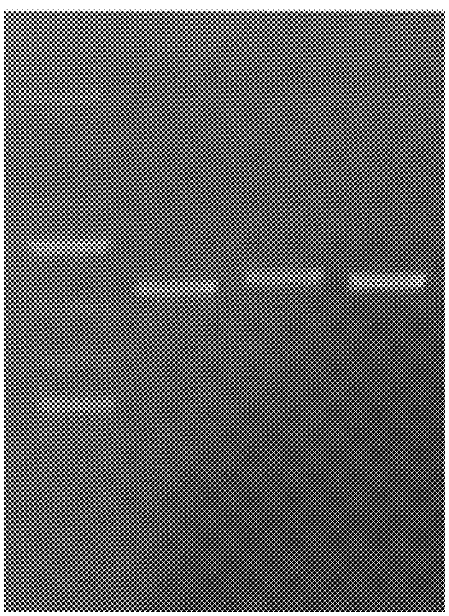

This example describes the generation of recombinant MVAΔE5R virus expressing hFl3L and hOX40L. FIG. 81 shows a scheme of generating recombinant MVAΔE5R expressing hFl3L and hOX40L through homologous recombination at the E4L and E6R loci of MVA genome. pMA vector was used to insert a single expression cassette designed to express both hFl3L and hOX40L using the vaccinia viral synthetic early and late promoter (PsE/L). The coding sequence of the hFl3L and hOX40L was separated by a cassette including a furin cleavage site followed by a Pep2A sequence. Homologous recombination that occurred at the E4L and E6R loci resulted in the insertion of expression cassette for hFl3L and hOX40L. FIGS. 82A and 82B demonstrate that the recombinant MVAΔE5R-hFlt3L-hOX40LhOX40L virus has the expected insertion as determined by PCR analysis. The DNA insert was also subjected to Sanger Sequencing and the sequences were as expected.

Example 82: Expression of hFlt3L and hOX40L by cells infected with MVAΔE5R-hFlt3L-hOX40L.

Figure 83A:
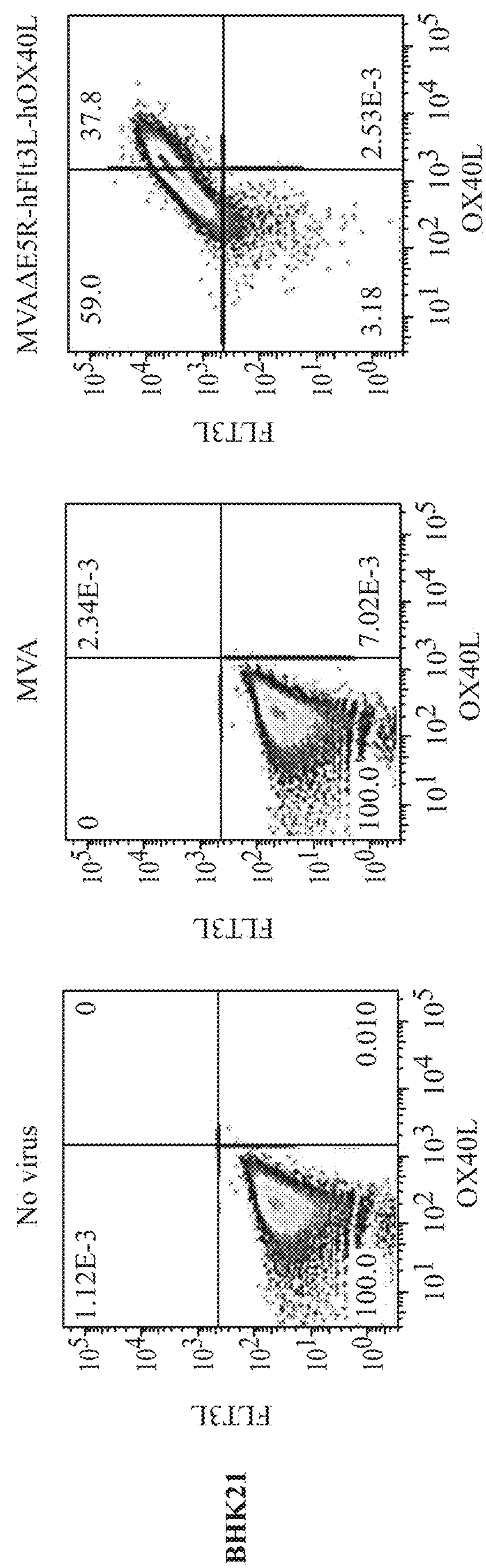
FIGS. 83A-83C show that MVAΔE5R-hFlt3L-hOX40L virus expresses both hFlt3L and hOX40L on the surface of infected cells.
Figure 83B:
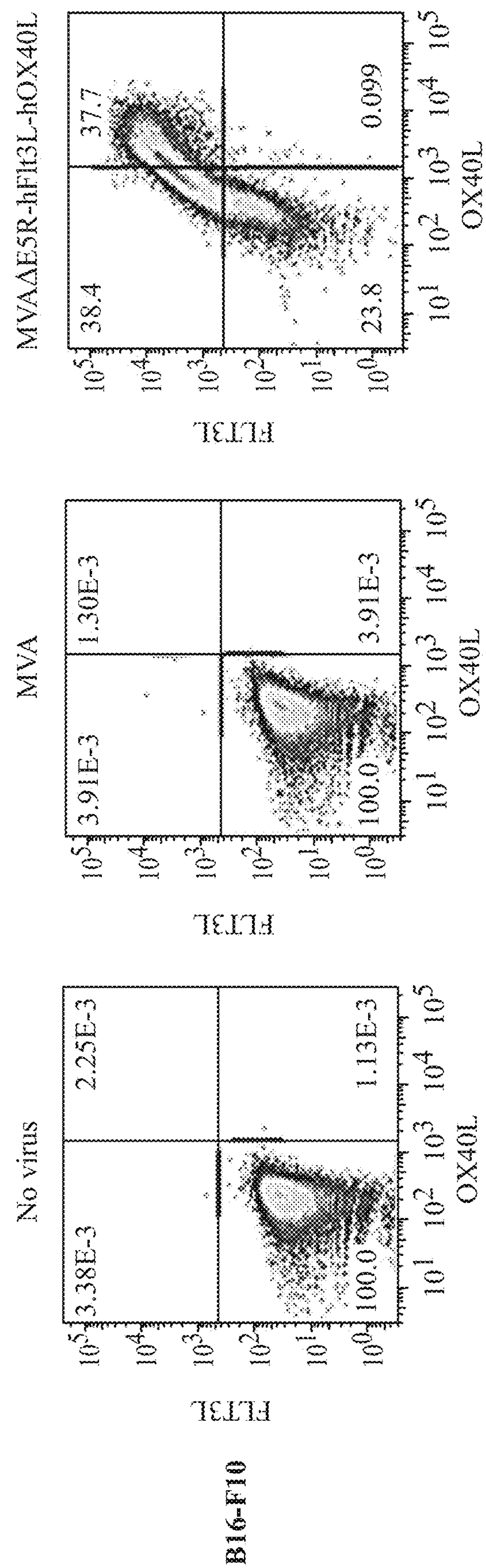
Figure 83C:
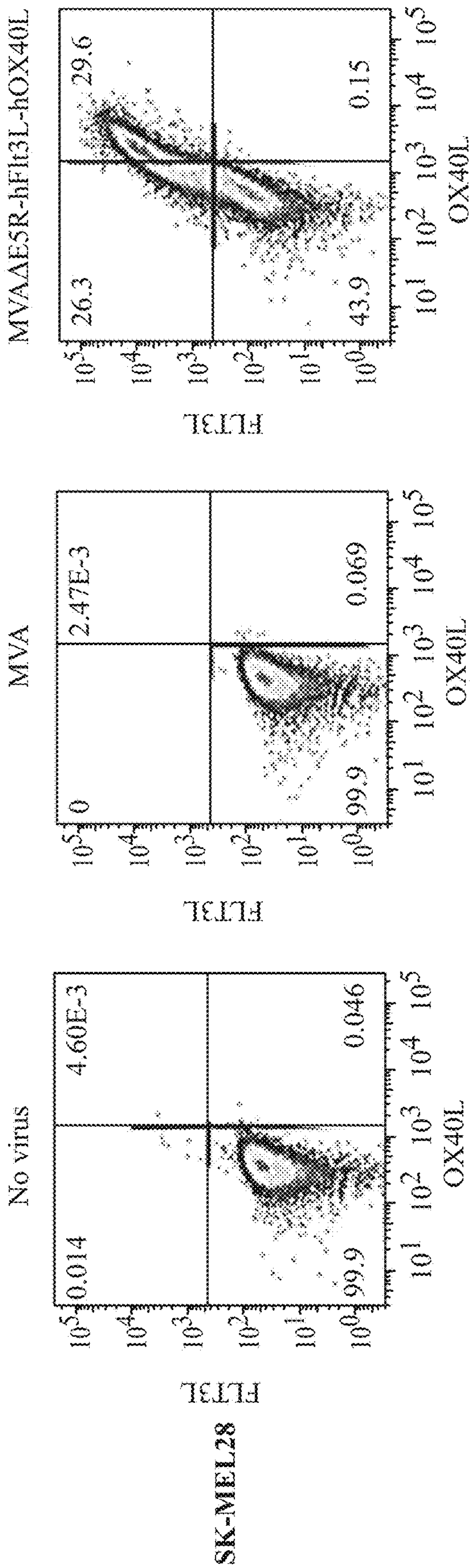

To test whether the recombinant MVAΔE5R-hFlt3L-hOX40LhOX40L virus expresses both hFl3L and hOX40L on the surface of infected cells, BHK-21, murine B16-F10 melanoma cells and human SK-MEL28 melanoma cells were plated and infected with either MVA or MVAΔE5R-hFlt3L-hOX40LhOX40L at MOI 10. A no virus, mock infection control was included. 24 hours post infection, cells were harvested for surface staining with hFl3L and hOX40L antibodies. Surface expression of hFl3L and hOX40L was analyzed by FACS analysis. FIG.83A are dot plots of surface expression of hFl3L and hOX40L in BHK-21 cells after infection. FIG.83B are dot plots of surface expression of hFl3L and hOX40L in B16-F10 cells after infection. FIG.83C are dot plots of surface expression of hFl3L and hOX40L in SK-MEL28 cells after infection. The results demonstrate that MVAΔE5R-hFlt3L-hOX40LhOX40L expressed hOX40L and hFl3L efficiently in BHK-21, B16-F10 and SK-MEL28 cells. Given that MVAΔE5R-hFlt3L-hOX40LhOX40L does not replicate in B16-F10 or SK-MEL28, the expression of hFl3L and hOX40L on the infected tumor cells was robust.

Figure 84:
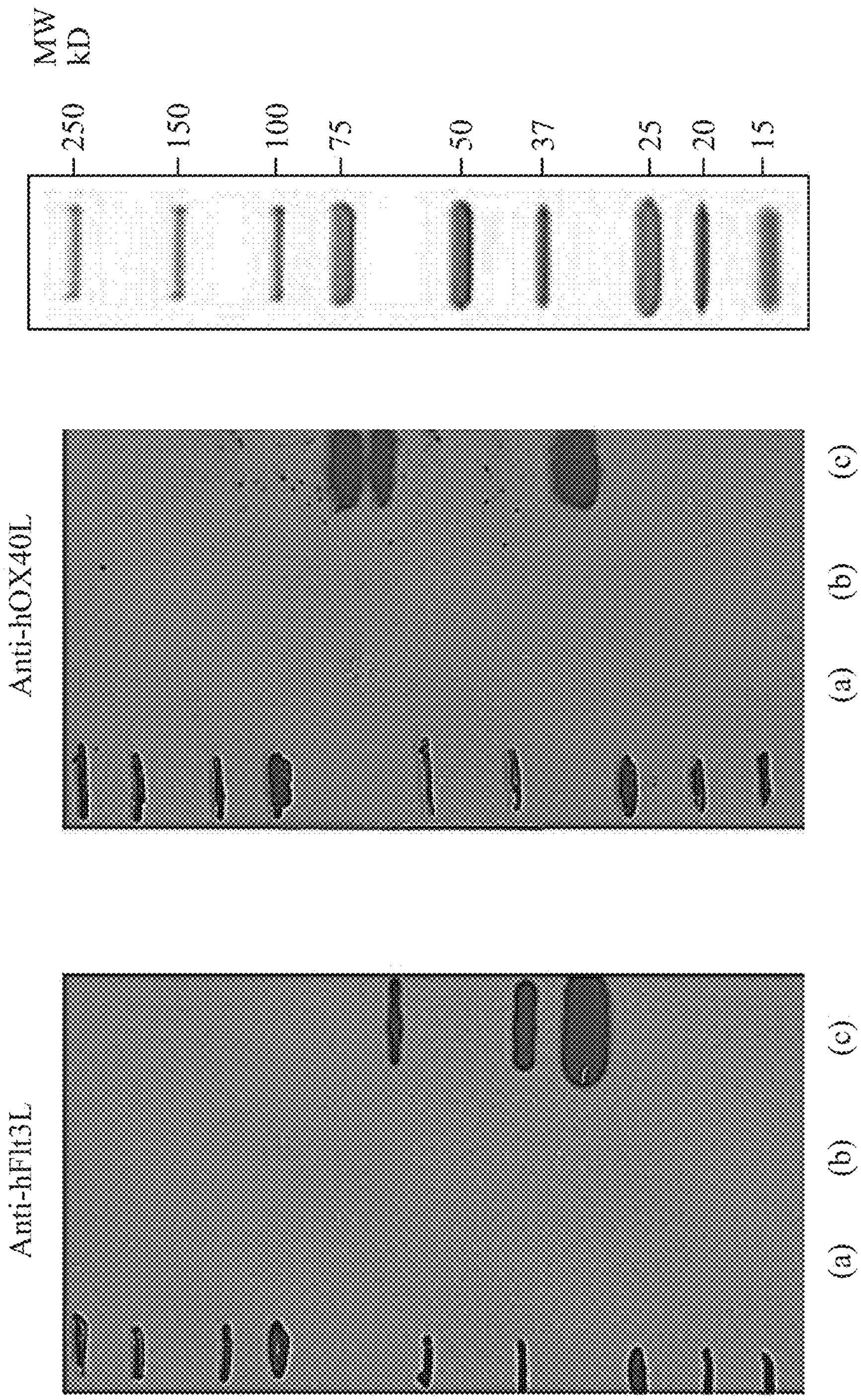
FIG. 84 shows Western blot results of the expression of hFl3L and hOX40L in MVAΔE5R-hFlt3L-hOX40LhOX40L-infected BHK21 cells. BHK21 cells were either mock infected, or infected with MVA or MVAΔE5R-hFlt3L-hOX40LhOX40L. Cells lysates were collected at 24 h post infection. Western blot analysis was performed using anti-hFl3L and anti-hOX40L antibodies.

Western blot analysis was performed to test whether MVAΔE5R-hFlt3L-hOX40LhOX40L virus expresses hFl3L and hOX40L on BHK21 cells (FIG. 84). Briefly, BHK21 cells were either mock infected or infected with MVA or MVAΔE5R-hFlt3L-hOX40LhOX40L. Cell lysates were collected at 24 h post infection. Western blot results show that hFl3L and hOX40L were expressed by MVAΔE5R-hFlt3L-hOX40LhOX40L-infected BHK21 cells, but not by MVA (FIG. 84).

Example 83: Generation of recombinant VACV-TK$^-$-anti-CTLA-4-ΔE5R-hFlt3L-mOX40L.

Figure 85A:
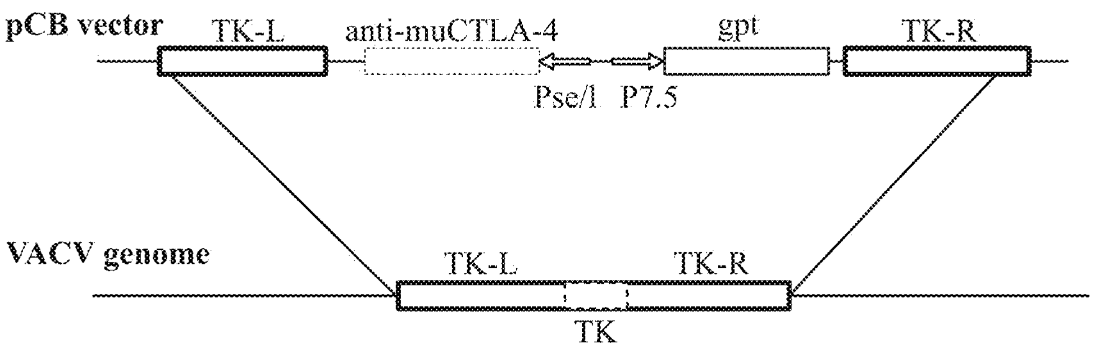
FIGS. 85A and 85B show a scheme to generate VACV-TK$^-$-anti-CTLA-4-ΔE5R-hFl3L-mOX40L.
Figure 85B:
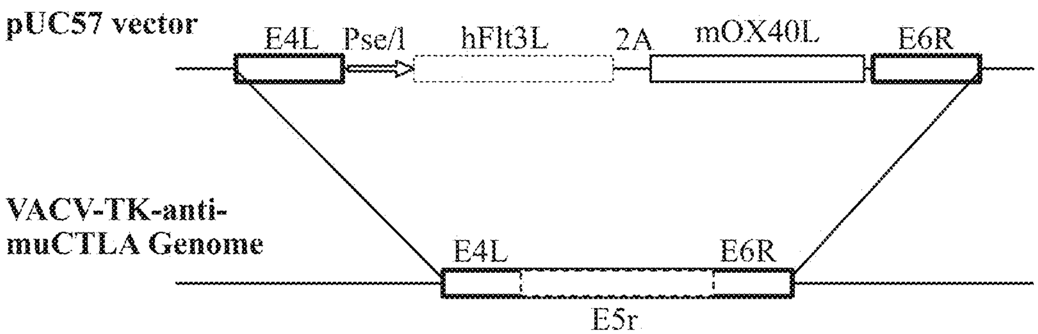

This example describes the generation of a recombinant vaccinia or MVA virus expressing an antibody that selectively targets cytotoxic T lymphocyte antigen 4 at the TK locus and expressing human Flt3L and murine OX40L genes in the E5R locus (VAC-TK$^-$-anti-muCTLA-4-E5R$^-$-hFl3L-mOX40L). FIG. 85A shows the schematic diagram of a single expression cassette designed to express the heavy chain and light of the antibody using the vaccinia viral synthetic early and late promoter (PsE/L). The coding sequence of the heavy chain (muIgG2a) and the light chain of 9D9 were separated by a cassette including a furin cleavage site followed by a 2A peptide (Pep2A) sequence to enable ribosome skipping. A pCB plasmid was constructed which contained the anti-mu-CTLA-4 gene under the control of the vaccinia PsE/L as well as the *E. coli* xanthine-guanine phosphoribosyl transferase gene (gpt) under the control of vaccinia P7.5 promoter flanked by the thymidine kinase (TK) gene on either side. Recombinant virus expressing anti-mu-CTLA-4 from TK locus was generated through homologous recombination at the TK locus between pCB plasmid DNA and viral genomic DNA. FIG. 85B shpws the schematic diagram which used the vaccinia viral synthetic early and late promoter (PsE/L) to express both human Flt3L and murine OX40L as a fusion protein in a single expression cassette. The coding sequence of human Flt3L and murine OX40L was separated by a cassette including a furin cleavage site followed by a 2A peptide (Pep2A) sequence, which enabled ribosome skipping. A pUC57 plasmid was constructed which contained human Flt3L and murine OX40L fusion gene flanked by the E4L and E6R genes on either side. Recombinant virus expressing human Flt3L and murine OX40L fusion protein from E5R locus was generated through homologous recombination at E5R locus between pUC57 plasmid DNA and viral genomic DNA. To generate the VAC-TK$^-$-anti-muCTLA-4-E5R$^-$-hFl3L-mOX40L, first BSC-40 cells were infected with vaccinia virus at a multiplicity of infection (MOI) of 0.05 for 1 h, and were then transfected with the pCB plasmid DNAs described above. The infected cells were collected at 48 h. Recombinant viruses were selected through further culturing in gpt selection medium including MPA, xanthine and hypoxanthine, and plaque purified. PCR analysis was performed to identify recombinant viruses with deletion of part of the TK gene and with anti-muCTLA-4 insertion. Homologous recombination that occurred at the TK locus resulted in the insertion of anti-mu-CTLA-4 and gpt expression cassettes into the viral genomic DNA to generate VAC-TK$^-$-anti-muCTLA-4. On the second step, BSC-40 cells were infected with VAC-TK$^-$-anti-muCTLA-4 at a MOI of 0.1 for 1 h, and then were transfected with the pUC57 plasmid DNAs described above. The infected cells were collected at 48 h. Recombinant viruses were selected through GFP marker and plaque purification. PCR analysis was performed to identify recombinant viruses with deletion of the E5R gene and with insertion of human Flt3L and murine OX40L fusion gene to generate VAC-TK$^-$-anti-muCTLA-4-E5R$^-$-hFl3L-mOX40L recombinant virus.

Example 84: PCR verification of recombinant VACV-TK$^-$-anti-muCTLA-4-ΔE5R-hFlt3L-mOX40L and the expression of anti-muCTLA-4 antibody by cells infected with the recombinant virus.

Figure 86A:
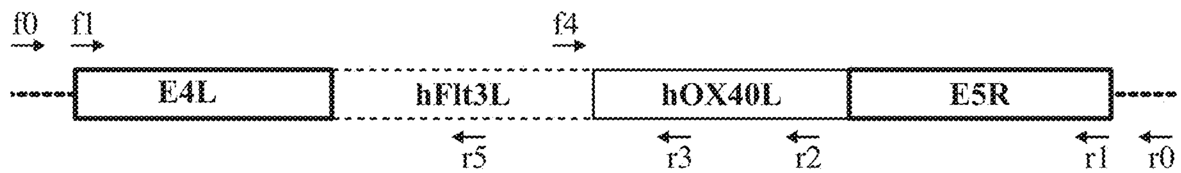
FIGS. 86A-86C show the scheme and the results of PCR analysis to verify the recombinant vaccinia virus VACV-TK$^-$-anti-muCTLA-4-E5R$^-$-hFl3L-mOX40L, as well as the Western blot results on the expression of anti-CTLA-4 antibodies by the cells infected with the recombinant virus.
Figure 86B:
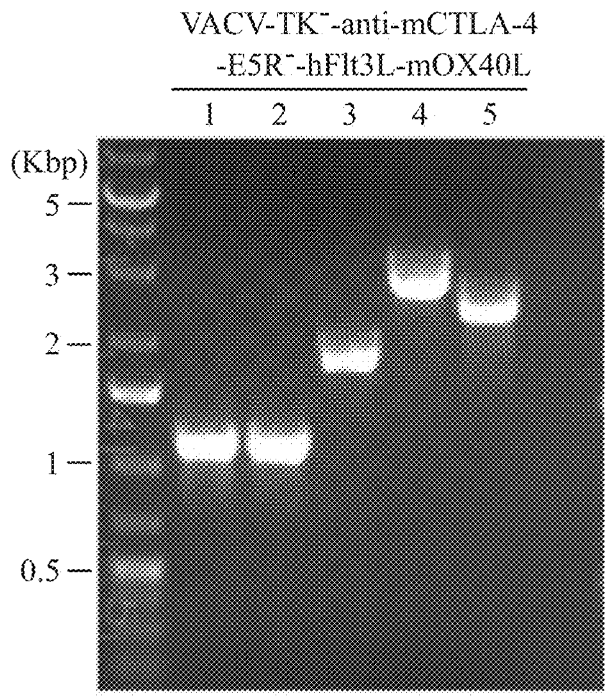
Figure 86C:
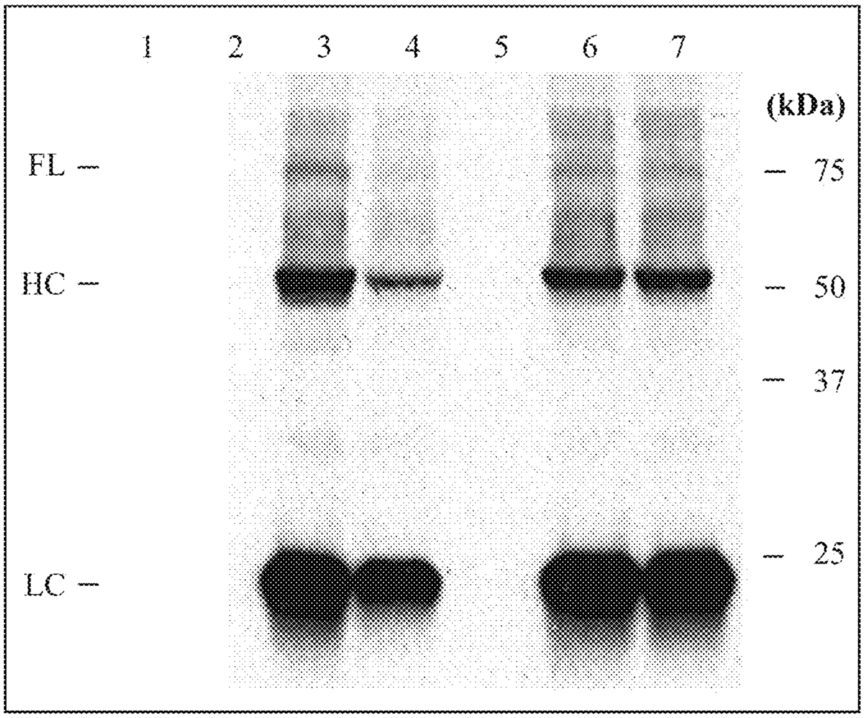

PCR analyses was used to verify the recombinant VACV-TK$^-$-anti-muCTLA-4-ΔE5R-hFl3L-mOX40L (FIGS. 86A and 86B). To determine whether recombinant virus infection results in the production of anti-CTLA-4 antibodies, human SK-MEL-28 melanoma cells were mock infected or infected with E3LΔ83N-TK$^-$-vector, E3LΔ83N-TK$^-$-hFl3L-anti-muCTLA-4, E3LΔ83N-TK$^-$-hFl3L-anti-muCTLA-4-C7L$^-$-mOX40L, VACV, VAC-TK$^-$-anti-muCTLA-4-C7L$^-$-mOX40L, or VAC-TK$^-$-anti-muCTLA-4-E5R$^-$-hFl3L-mOX40L at a MOI of 10. Cell lysates were collected at 24 h post-infection, and polypeptides were separated using 10% SDS-PAGE. HRP-linked anti-mouse IgG (heavy and light chain) antibody was used to detect full-length (FL), heavy chain (HC), and light chain (LC) of anti-muCTLA-4 antibodies. Western blot analysis shows the expression of the full-length (FL), heavy chain (HC), and light chain (LC) of anti-CTLA-4 antibodies in SK-MEL-28 melanoma cell lines after virus infection (FIG. 86C). Accordingly, these results demonstrate that the recombinant viruses of the present technology have the capacity to express anti-CTLA-4 antibodies in infected cells and are useful in methods for delivering the antibodies to cells.

Example 85: Vaccinia E5 is highly conserved among the poxvirus family.

Vaccinia E5 is highly conserved among the poxvirus family. FIG. 87 shows the protein sequence alignments of E5 orthologs from multiple members of the poxvirus family. E5 orthologs exhibit differences in N-terminals but high conservation in middle to C-terminal. FIG. 88A shows the protein sequence alignments of E5 from Vaccinia WR and Modified vaccinia virus Ankara (MVA). MVA lacks the first 10 amino acids and point mutations at N-terminal compared with VACV. FIG. 88B shows the protein sequence alignments of E5 from vaccinia virus and M31, which is the E5 orthologue in Myxoma virus. M31 and E5 from vaccinia virus share about 20% homology.

Example 86: Myxoma virus M31, an ortholog of vaccinia E5, inhibits cGAS and STING induced IFN-β pathway.

Figure 89A:
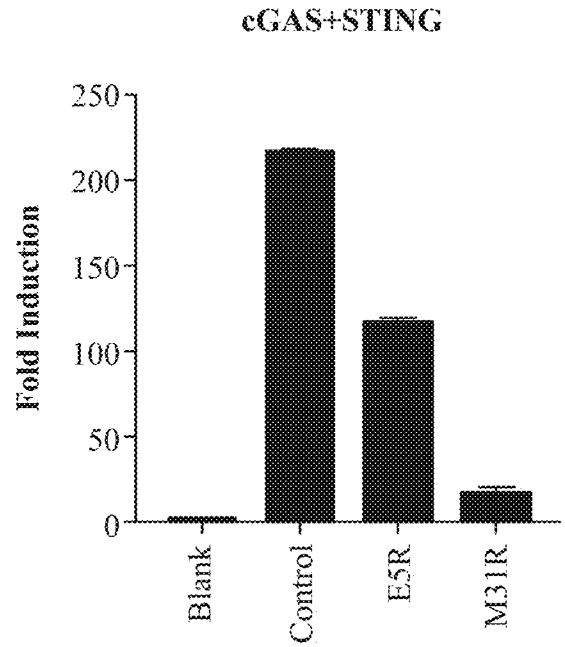
FIGS. 89A and 89B show that myxoma virus M31R inhibits cGAS and STING induced IFN-β pathway.
Figure 89B:
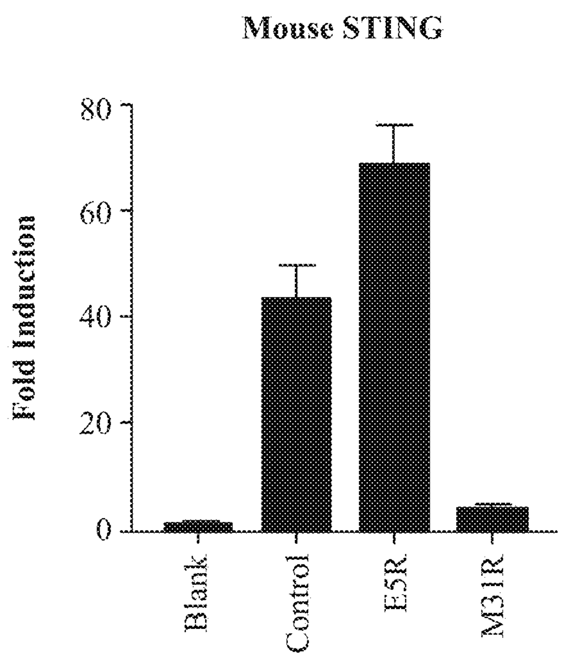

To investigate the role of Myxoma virus M31, an ortholog of vaccinia E5, in cGAS and STING induced IFN-β pathway, HEK293T cells were transfected with plasmids expressing murine cGAS, human STING together with either E5R, M31R or pcDNA vector control expressing plasmids. After 24 h, cells were harvest for a luciferase assay. FIG. 89A demonstrated that both E5 and M31 were able to inhibit IFN-β production. Myxoma M31 demonstrated a stronger inhibition effect than E5. FIG. 89B shows that HEK293T were transfected with plasmids expressing murine STING together with either E5R, M31R or pcDNA vector control expressing plasmids. 24 h post transfection, the luciferase signal was determined. E5 did not block IFN-β production while M31 still inhibited STING-induced IFN-β production, which demonstrated that M31 may act downstream of the cGAS and STING induced IFN-β pathway.

Example 87: Vaccinia E5 promotes cGAS ubiquitination.

Figure 90A:
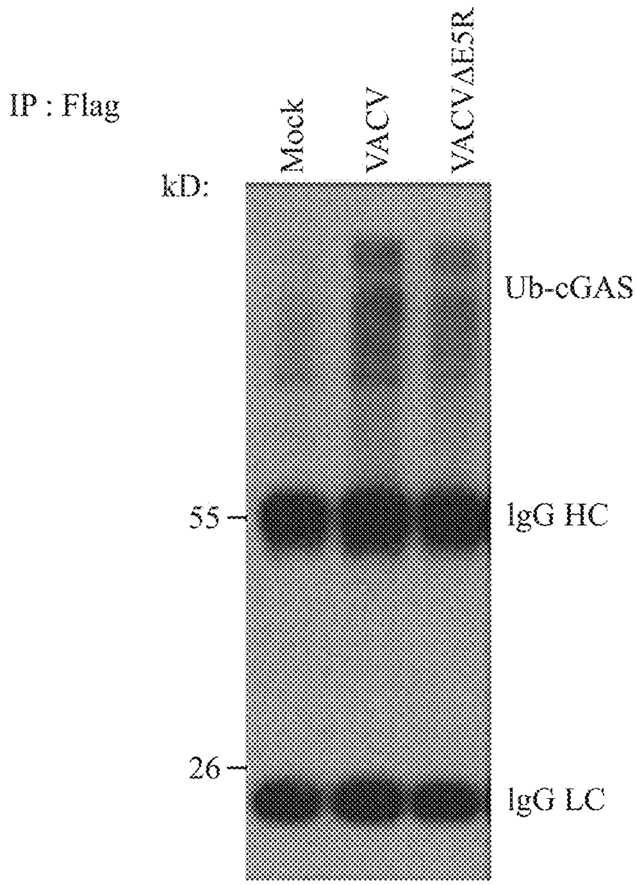
FIGS. 90A and 90B show that vaccinia E5 promotes cGAS ubiquitination.
Figure 90B:
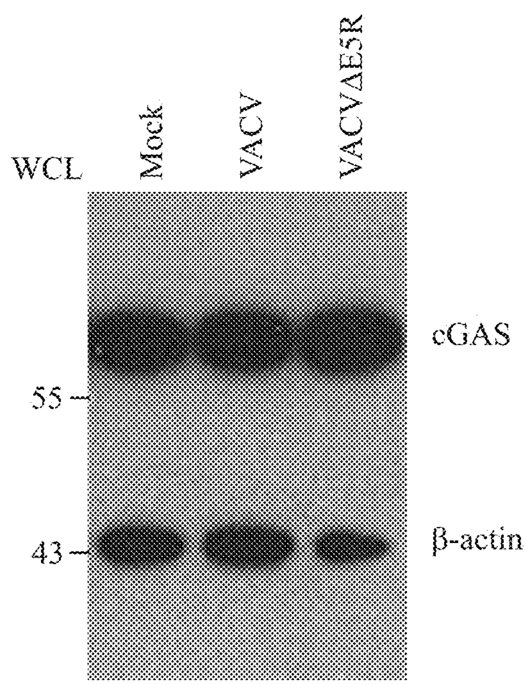

To assess whether E5 blocks cGAS induced IFN-β pathway by promoting cGAS ubiquitination, HEK293T cells were transfected with Flag-cGAS and HA-ubiquitin. After 24 hours, cells were infected with either WT VACV or VACVΔE5R. Cell lysis were collected 6 hpi. cGAS were immunoprecipitated with anti-Flag antibody and ubiquitination was detected by anti-HA antibody (FIG. 90A). FIG. 90B shows a Western Blot analysis of cGAS and β-actin on whole cell lysates (WCL). VACV induced cGAS ubiquitination after infection while VACVΔE5R induced lower level of cGAS ubiquitination, which demonstrated that vaccinia E5 promotes cGAS ubiquitination.

Example 88: Intratumoral delivery of MVAΔE5R delays tumor growth and prolongs survival in murine B16-F10 melanoma unilateral tumor implantation model.

To test whether IT delivery of MVAΔE5R generates antitumor effects, a unilateral murine B16-F10 tumor implantation model was used. Briefly, $5\times10^5$ B16-F10 melanoma cells were implanted intradermally to right flanks of C57B/6 mice. Eight days after tumor implantation, the tumors were injected with PBS or $4\times10^7$ pfu of MVA, MVAΔE5R or Heat-iMVA twice a week. Tumor sizes were measured twice a week and mice survival was monitored (FIG. 91A). The mice survival rate is shown in FIG. 91B. In mice treated with PBS, B16-F10 tumors grew rapidly, which resulted in early death with a median survival of 11 days. Intratumoral injection of MVAΔE5R had superior antitumor effect than MVA, which resulted in delayed tumor growth and improved survival. IT MVAΔE5R received equivalent anti-tumor effect to Heat-iMVA with 60% of mice survived in both MVAΔE5R and Heat-iMVA treated group.

Example 89: MVAΔC7L-hFlt3L-TK(−)mOX40LΔE5R infection of BMDCs results in higher levels of IFNB gene expression and IFN-β protein secretion compared with MVAΔE5R.

Figure 92A:
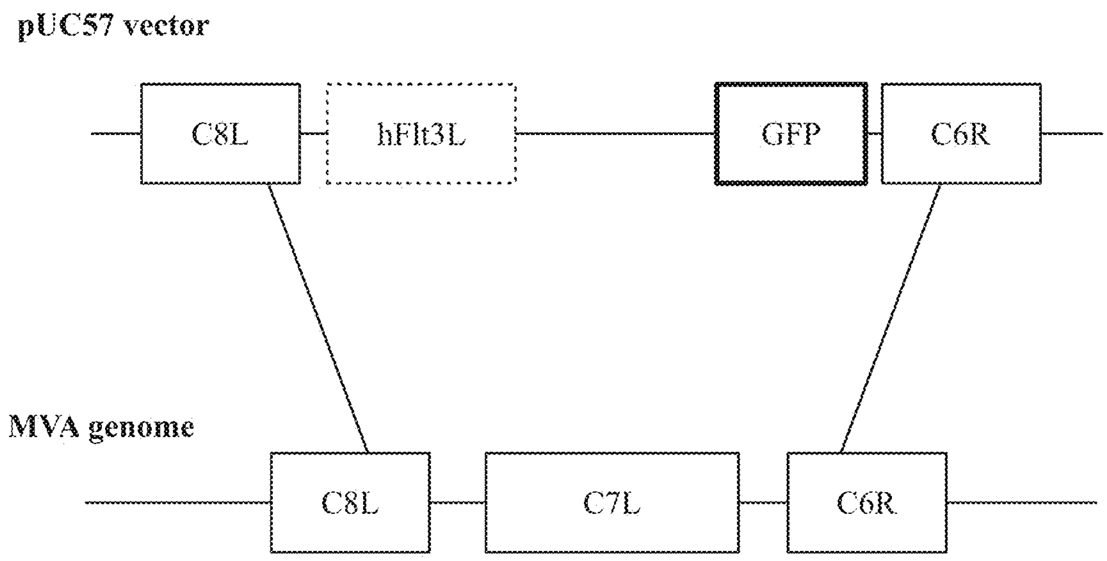
FIGS. 92A-92E show that MVAΔC7L-hFl3L-TK(−) mOX40LΔE5R infection of BMDCs results in higher levels of IFNB gene expression and IFN-β protein secretion compared with MVAΔE5R.
Figure 92B:
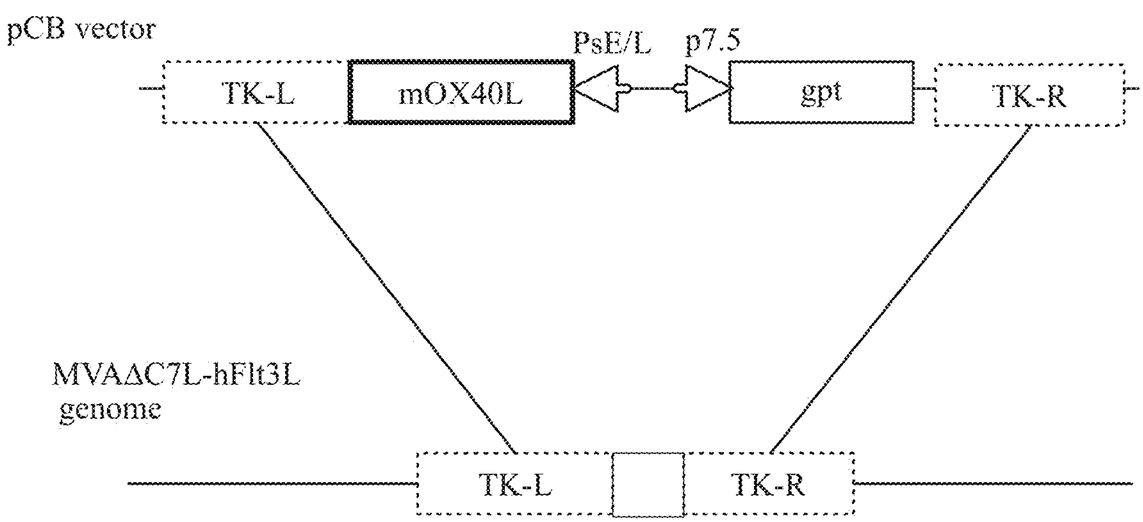
Figure 92C:
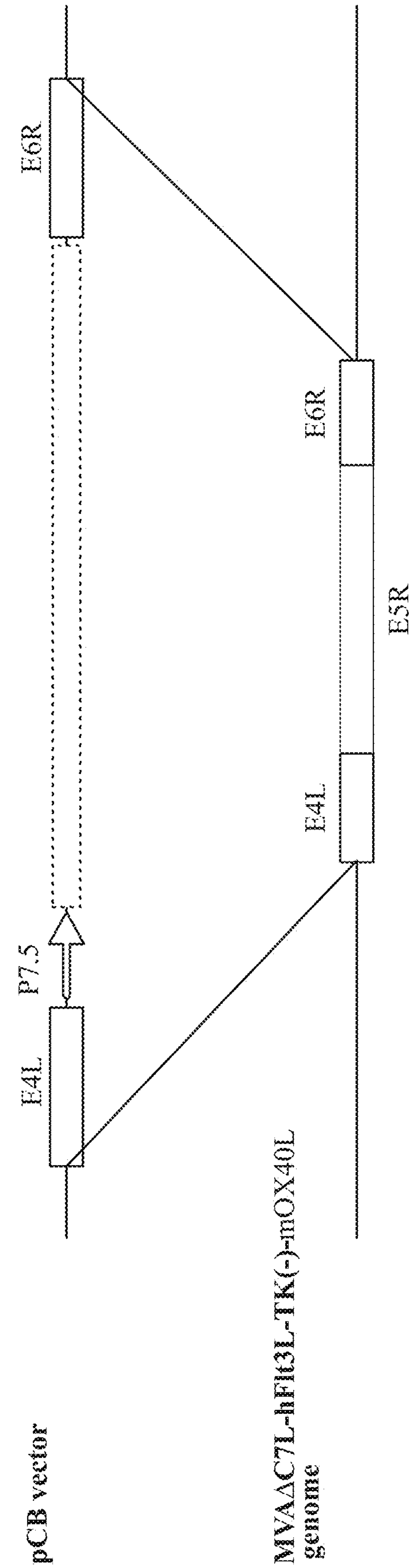
Figure 92D:
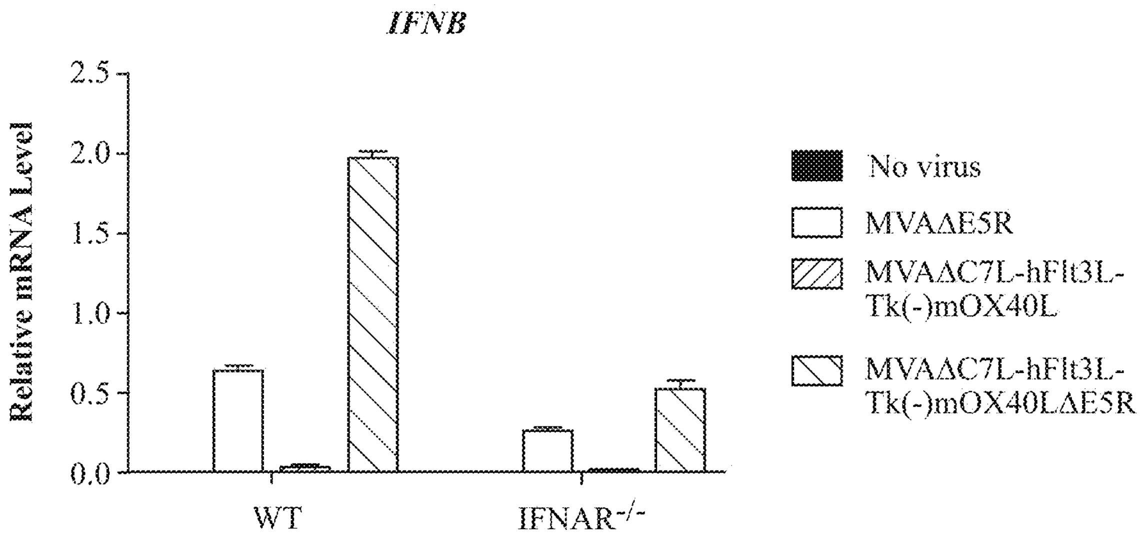
Figure 92E:
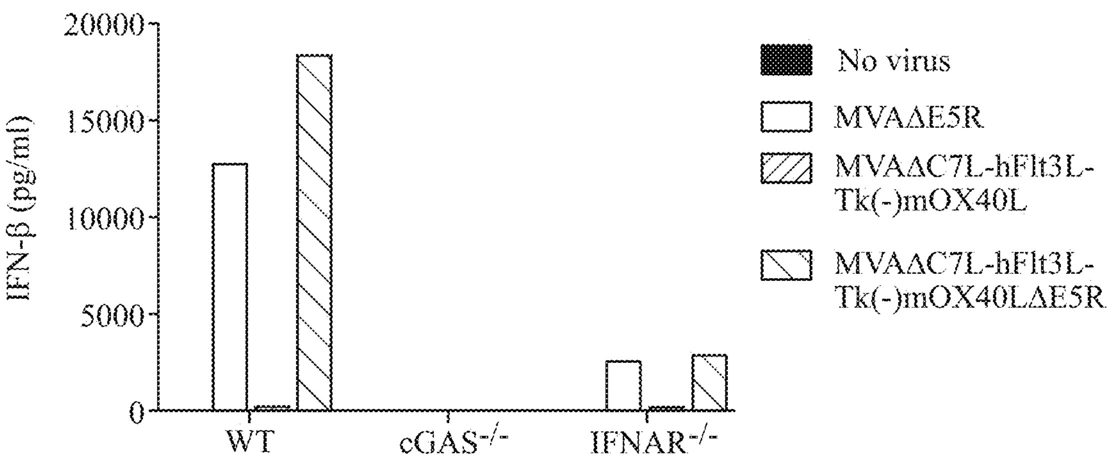

FIGS. 92A-C show that MVAΔC7L-hFl3L-TK(−)mOX40LΔE5R infection of BMDCs results in higher levels of IFNB gene expression and IFN-β protein secretion compared with MVAΔE5R. FIG. 92A-92C shows a schematic diagram of generating MVAΔC7L-hFl3L-TK(−)-mOX40LΔE5R virus. The first step involved the generation of MVAΔC7L-hFl3L through homologous recombination at the C8L and C6R loci, replacing C7L C7Lgene with hFl3L under the control of PsE/L promoter. The second step involved the generation of MVAΔC7L-hFlt3L-TK(−)-mOX40LC7LhFl3LmOX40Lthrough homologous recombination at the TK loci, replacing TK gene with mOX40L under the control of PsE/L promoter. The resulting virus was described in FIGS. 5A and 5B. The third step was to generate MVAΔC7L-hFl3L-TK(−)-mOX40LΔE5R through homologous recombination at the E4L and E6R loci, which replaced the E5R gene with mCherry under the control of P7.5 promoter. FIG. 92D shows RT-PCR results of IFNB gene expression in BMDCs infected with either MVAΔE5R, MVAΔC7L-hFl3L-TK(−)-mOX40L, or MVAΔC7L-hFl3L-TK(−)mOX40LΔE5R. WT and IFNAR$^{-/-}$ BMDCs were mock-infected or infected with MVAΔE5R, MVAΔC7L-hFl3L-TK(−)-mOX40L, or MVAΔC7L-hFl3L-TK(−)mOX40LΔE5R at a MOI of 10. Cells were collected at 16 h post infection and RT-PCR was performed. FIG. 92E shows ELISA results of IFN-β protein levels in the supernatants of BMDCs infected with either MVAΔE5R, MVAΔC7L-hFl3L-TK(−)-mOX40L, or MVAΔC7L-hFl3L-TK(−)mOX40LΔE5R. WT and IFNAR$^{-/-}$ BMDCs were mock-infected or infected with MVAΔE5R, MVAΔC7L-hFl3L-TK(−)-mOX40L, or MVAΔC7L-hFl3L-TK(−)mOX40LΔE5R at a MOI of 10. Supernatants were collected at 16 h post infection and ELISA was performed to measure IFN-β protein levels. MVAΔC7L-hFl3L-TK(−)-mOX40LΔE5R induced highest IFN-β production in both RNA level and protein secretion in WT BMDCs compared with MVAΔE5R and MVAΔC7L-hFl3L-TK(−)-mOX40L. In IFNAR-BMDCs, IFN-production induced by MVAΔC7L-hFl3L-TK(−)-mOX40LΔE5R was much lower than that in WT BMDCs, which demonstrated that MVAΔC7L-hFl3L-TK(−)-mOX40LΔE5R induced IFN-β production is partially dependent on the IFNAR pathway.

Example 90: Generating MVAΔC7LΔE5R-hFlt3L-mOX40L and MVAΔC7L-OVA-ΔE5R-hFlt3L-mOX40L.

Figure 93A:
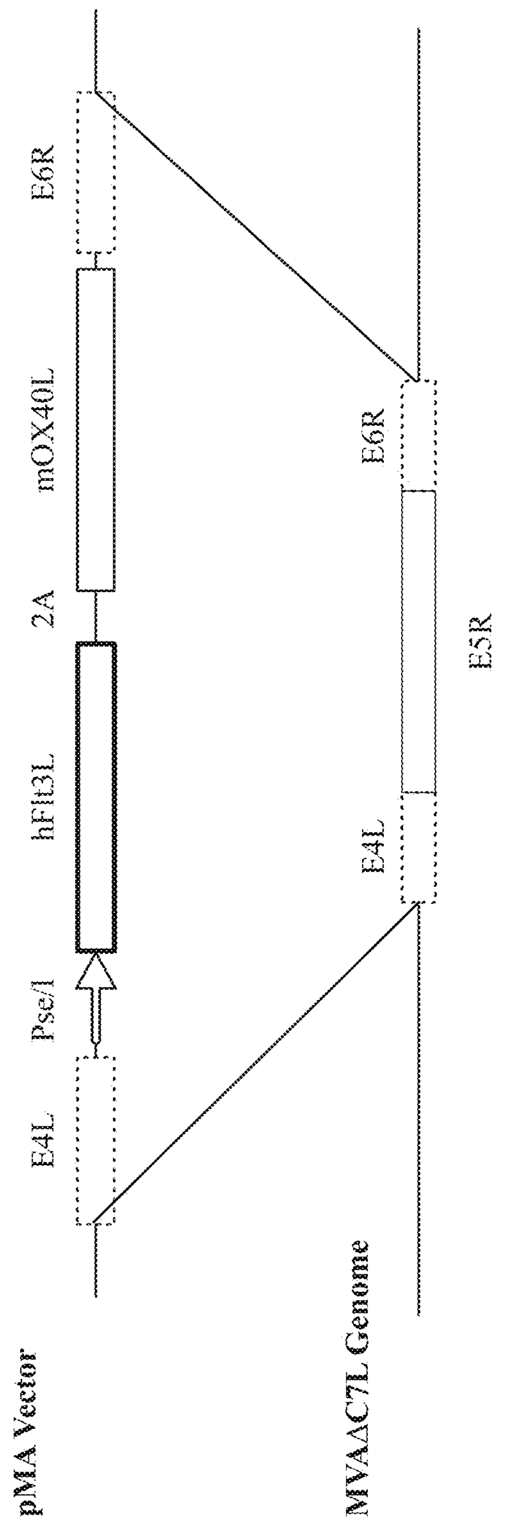
FIGS. 93A and 93B show the scheme of generating MVAΔC7LΔE5R-hFl3L-mOX40L and MVAΔC7L-OVA-ΔE5R-hFl3L-mOX40L.
Figure 93B:
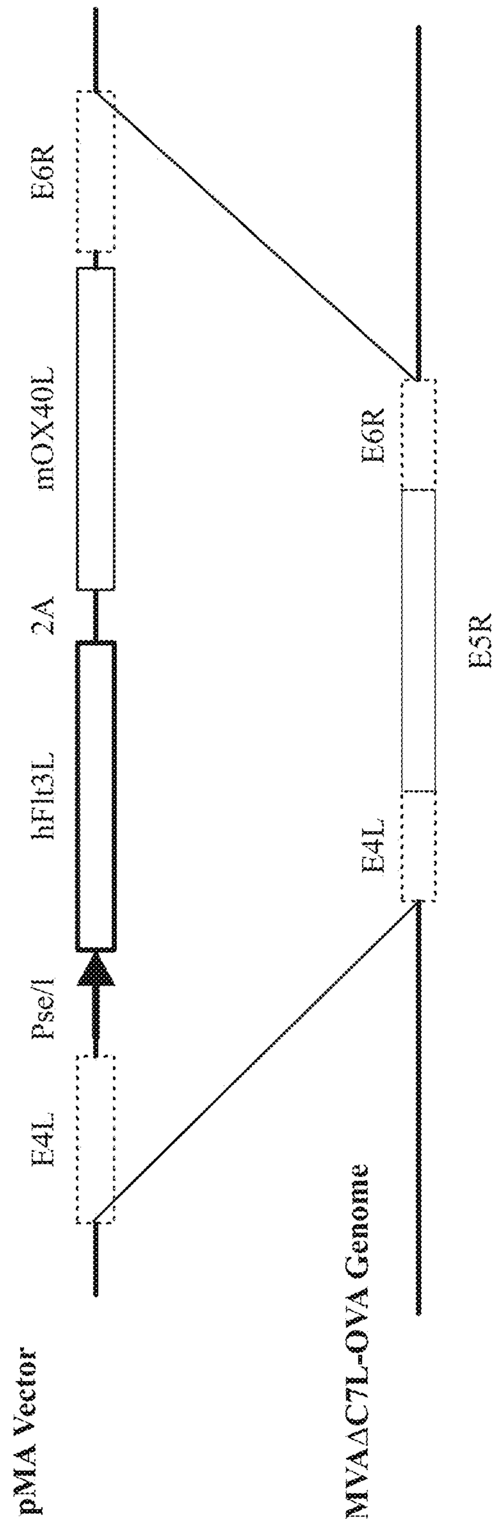

FIGS. 93A and 93B shows the scheme of generating MVAΔC7LΔE5R-hFl3L-mOX40L and MVAΔC7L-OVA-ΔE5R-hFl3L-mOX40L. FIG. 93A shows the scheme of generating MVAΔC7LΔE5R-hFl3L-mOX40L. pMA plasmid was constructed to use the vaccinia viral synthetic early and late promoter (PsE/L) to express both human Flt3L and murine OX40L as a fusion protein in a single expression cassette. The coding sequence of human Flt3L and murine OX40L was separated by a cassette including a furin cleavage site followed by a 2A peptide (Pep2A) sequence.

Recombinant virus expressing human Flt3L and murine OX40L fusion protein from E5R locus was generated through homologous recombination at E4L and E6R loci between pMA plasmid and MVAΔC7L C7Lviral genome. FIG. 93B shows the scheme of generating MVAΔC7L-OVA-ΔE5R-hFl3L-mOX40L. Recombinant virus expressing human Flt3L and murine OX40L fusion protein from E5R locus was generated through homologous recombination at E4L and E6R loci between pMA plasmid and MVAΔC7L-OVA viral genome.

Example 91: Myxoma M64 has an inhibitory role of IFN-β-induced IFN-sensitive response element activation.

Figure 94A:
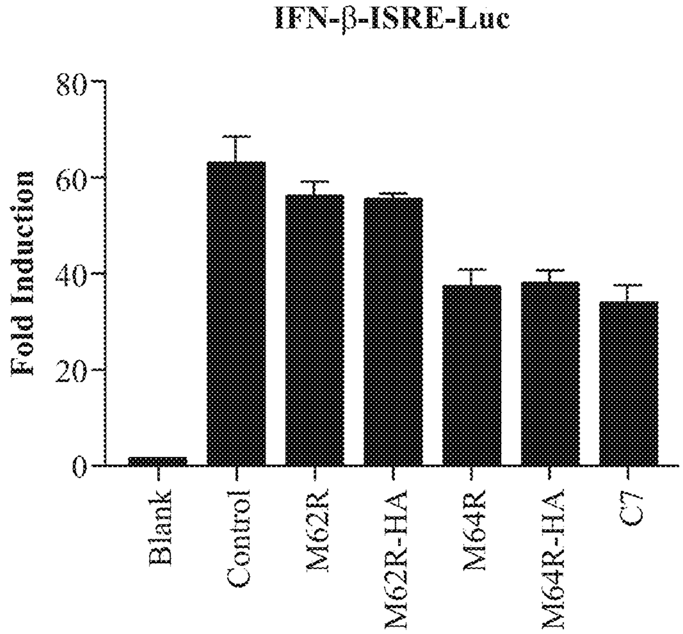
FIGS. 94A and 94B.

To determine whether myxoma M62 or M64 has similar inhibitory effect of C7 on IFNAR signaling, HEK293T cells were transfected with ISRE-firefly luciferase reporter, a control plasmid pRL-TK that expresses Renilla luciferase, myxoma M62R, Myxoma M62R-HA, Myxoma M64R, Myxoma M64R-HA, vaccinia C7L-expressing or control plasmid. 24 h post transfection, cells were treated with IFN-β for another 24 h before harvesting. Luciferase activities were measured. The results demonsrate that transient overexpression of myxoma M64 inhibits IFN-β-induced ISRE activation (FIG. 94A).

Figure 94B:
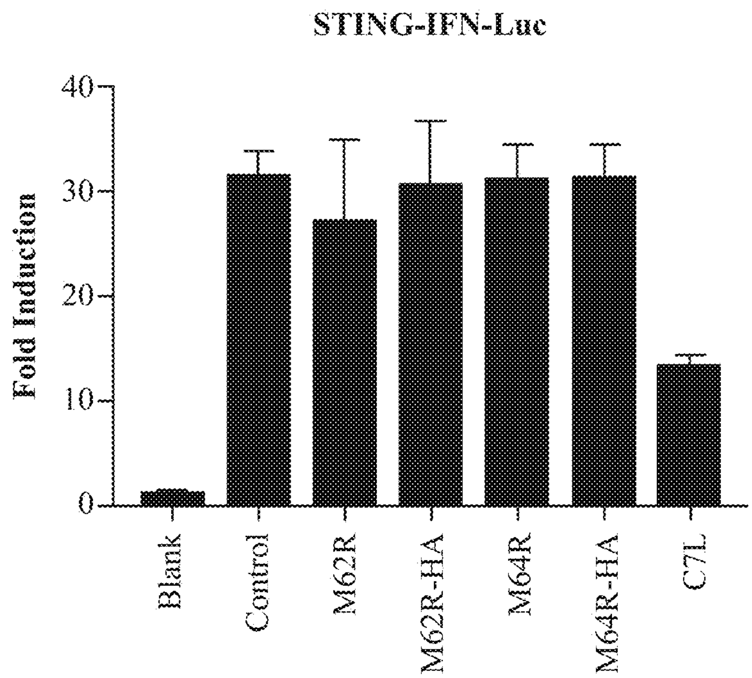

To determine whether myxoma M62 or M64 has similar inhibitory effect of C7 on STING-induced IFNB promoter activation, HEK293T cells were transfected with ISRE-firefly luciferase reporter, a control plasmid pRL-TK that expresses Renilla luciferase, and STING-expressing plasmid, together with either myxoma M62R, Myxoma M62R-HA, Myxoma M64R, Myxoma M64R-HA, vaccinia C7L-expressing, or control plasmid. The results demonstrate that transient overexpression of myxoma M64 or M62 fails to inhibit STING-induced IFNB promoter activation (FIG. 94B).

Example 92: The combination of IT injection of the engineered poxviruses of the present technology with systemic delivery of any combination of (i) one or more immune checkpoint blocking agents and/or one or more immune system stimulators; (ii) one or more anti-cancer drugs; and (iii) an immunomodulatory drug (i.e., fingolimod (FTY720)) is more effective than IT virus alone in treating a solid tumor.

To test whether the combination with IT delivery of the engineered poxviruses of the present technology (e.g., MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3-LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM-63RΔM64R-hFlt3L-OX40L, MYXVΔM62RΔM63R-ΔM64R-hFlt3L-OX40L, MYXVΔM62RΔM63RΔM64-RΔM31R-hFlt3L-OX40L, MYXVΔM62RΔM63RΔM6-4RΔM31R-hFlt3L-OX40L-IL-12, MYXVΔM62RΔM6-3RΔM64RΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM-64RΔM31R-hFlt3L-OX40L-IL-12-IL-15/IL-15Rα-anti-CTLA-4) and systemic delivery of any combination of: (i) one or more immune checkpoint blocking agents and/or one or more immune system stimulators; (ii) one or more anti-cancer drugs; and (iii) an immunomodulatory drug (i.e., fingolimod (FTY720)) had superior anti-tumor efficacy compared with IT virus alone against large established B16-F10 melanoma, $5\times10^5$ cells are intradermally implanted into the right flanks of C57B/6 mice. Nine days after tumor implantation, when the tumors were 5 mm in diameter, they are treated with either: (a) IT PBS; (b) IT MVAΔE3L-OX40L, MVAΔC7L-OX40L, MVAΔC7L-hFlt3L-OX40L, MVAΔC7LΔE5R-hFlt3L-OX40L, MVAΔE5R-hFlt3L-OX40L, MVAΔE3LΔE5R-hFlt3L-OX40L, MVAΔE5R-hFlt3L-OX40L-ΔC11R, MVAΔE3LΔE5R-hFlt3L-OX40L-ΔC11R, VACVΔC7L-OX40L, VACVΔC7L-hFlt3L-OX40L, VACVΔE5R, VACV-TK⁻-anti-CTLA-4-ΔE5R-hFlt3L-OX40L, VACVΔB2R, VACVE3LΔ83NΔB2R, VACVΔE5RΔB2R, VACVE3LΔ83NΔE5RΔB2R, VACVE3LΔ83N-ΔTK-anti-CTLA-4-ΔE5R-hFlt3L-OX40L-IL-12, VACVE3LΔ83N-ΔTK-anti-CTLA-4-ΔE5R-hFlt3L-OX40L-IL-12-ΔB2R, MYXVΔM31R, MYXVΔM31R-hFlt3L-OX40L, MYXVΔM63R, MYXVΔM64R, MVAΔWR199, MVAΔE5R-hFlt3L-OX40L-ΔWR199, MVAΔE3LΔE5R-hFlt3L-mOX40LΔWR199-hIL-12, MVAΔE3LΔE5R-hFlt3L-mOX40LΔWR199-hIL-12ΔC11R, MVAΔE3LΔE5R-hFlt3L-mOX40LΔWR199-hIL-12ΔC11R-hIL-15/IL-15α, VACVΔE5R-IL-15/IL-15Rα, VACVΔE5R-IL-15/IL-15Rα-OX40L, VACVΔE3L83N-ΔTK-anti-huCTLA-4-ΔE5R-hFlt3L-hOX40L-hIL-12ΔB2RΔWR199ΔWR200, VACVΔE3L83N-ΔTK-anti-huCTLA-4-ΔE5R-hFlt3L-hOX40L-hIL-12ΔB2RΔWR199ΔWR200-hIL-15/IL-15Rα, VACVΔE3L83N-ΔTK-anti-huCTLA-4-ΔE5R-hFlt3L-hOX40L-hIL-12ΔB2RΔWR199ΔWR200ΔC11R, VACVΔE3L83N-ΔTK-anti-huCTLA-4-ΔE5R-hFlt3L-hOX40L-hIL-12ΔB2RΔWR199ΔWR200-hIL-15/IL-15RαΔC11R, MYXVΔM63RΔM64R, MYXVΔM62R, MYXVΔM62RΔM63RΔM64R, MYXVΔM31R, MYXVΔM62RΔM63RΔM64RΔM31R, MYXVΔM63R-ΔM64R-hFlt3L-OX40L, MYXVΔM62RΔM63RΔM64R-hFlt3L-OX40L, MYXVΔM62RΔM63RΔM64RΔM31R-hFlt3L-OX40L, MYXVΔM62RΔM63RΔM64RΔM31R-hFlt3L-OX40L-IL-12, MYXVΔM62RΔM63RΔM64R-ΔM31R-hFlt3L-OX40L-IL-12-IL-15/IL-15Rα, MYXVΔM62RΔM63RΔM64RΔM31R-hFlt3L-OX40L-IL-12-anti-CTLA-4, and/or MYXVΔM62RΔM63RΔM64R-ΔM31R-hFlt3L-OX40L-IL-12-IL-15/IL-15Rα-anti-CTLA- 4 plus IP administration of (i) one or more immune checkpoint blocking agents and/or one or more immune system stimulators; (ii) one or more anti-cancer drugs; and (iii) an immunomodulatory drug (i.e., fingolimod (FTY720)); twice weekly. Tumor volumes are measured and mice survival is monitored. It is anticipated that the combined administration of one or more engineered poxviruses of the present technology and: (i) one or more immune checkpoint blocking agents and/or one or more immune system stimulators; (ii) one or more anti-cancer drugs; and/or (iii) an immunomodulatory drug (i.e., fingolimod (FTY720)) will result in enhanced anti-tumor effects as compared to the administration of the engineered poxvirus alone.

Accordingly, these results will show that the combined administration of engineered poxviruses of the present technology and (i) one or more immune checkpoint blocking agents and/or one or more immune system stimulators; (ii) one or more anti-cancer drugs; and/or (iii) an immunomodulatory drug (i.e., fingolimod (FTY720)), are useful in methods for treating solid tumors. It is further anticipated that the combined administration of engineered poxviruses of the present technology and (i) one or more immune checkpoint blocking agents and/or one or more immune system stimulators; (ii) one or more anti-cancer drugs; and/or (iii) an immunomodulatory drug (i.e., fingolimod (FTY720)) will produce synergistic effects in this regard as compared to the administration of engineered poxvirus alone.

Example 93: Generation of recombinant MVAΔE5R expressing hFlt3L and mOX40L

Figure 95:
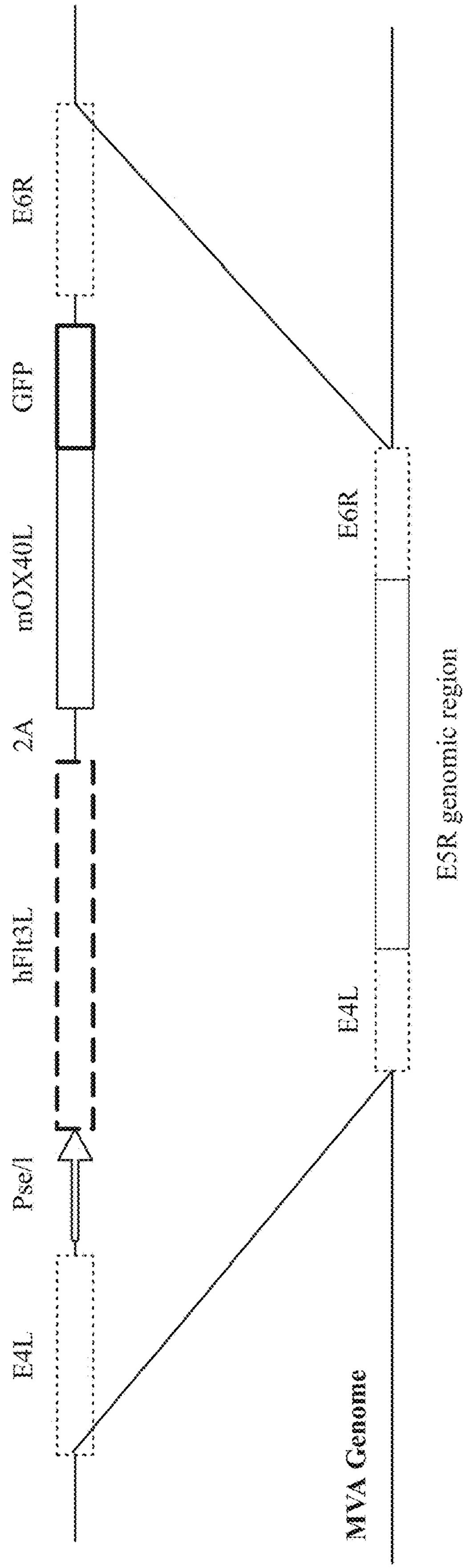
FIG. 95 shows a scheme of generating recombinant MVAΔE5R expressing hFl3L and mOX40L through homologous recombination at the E4L and E6R loci of the MVA genome. pUC57 vector was used to insert a single expression cassette designed to express both hFl3L and mOX40L using the vaccinia viral synthetic early and late promoter (PsE/L). The coding sequence of the hFl3L and mOX40L was separated by a cassette including a furin cleavage site followed by a Pep2A sequence. Homologous recombination that occurred at the E4L and E6R loci results in the insertion of expression cassette for hFl3L and mOX40L.

This example describes the generation of recombinant MVAΔE5R virus expressing hFlt3L and mOX40L. FIG. 95 shows a scheme of generating recombinant MVAΔE5R expressing hFl3L and mOX40L through homologous recombination at the E4L and E6R loci of MVA genome. pUC57 vector is used to insert a single expression cassette designed to express both hFl3L and mOX40L using the vaccinia viral synthetic early and late promoter (PsE/L). The coding sequence of the hFl3L and mOX40L was separated by a furin cleavage site followed by a Pep2A sequence. Homologous recombination that occurred at the E4L and E6R loci results in the insertion of expression cassette for hFl3L and mOX40L.

Example 94: Expression of hFlt3L and mOX40L by cells infected with MVAΔE5R-hFlt3L-mOX40L.

Figure 96A:
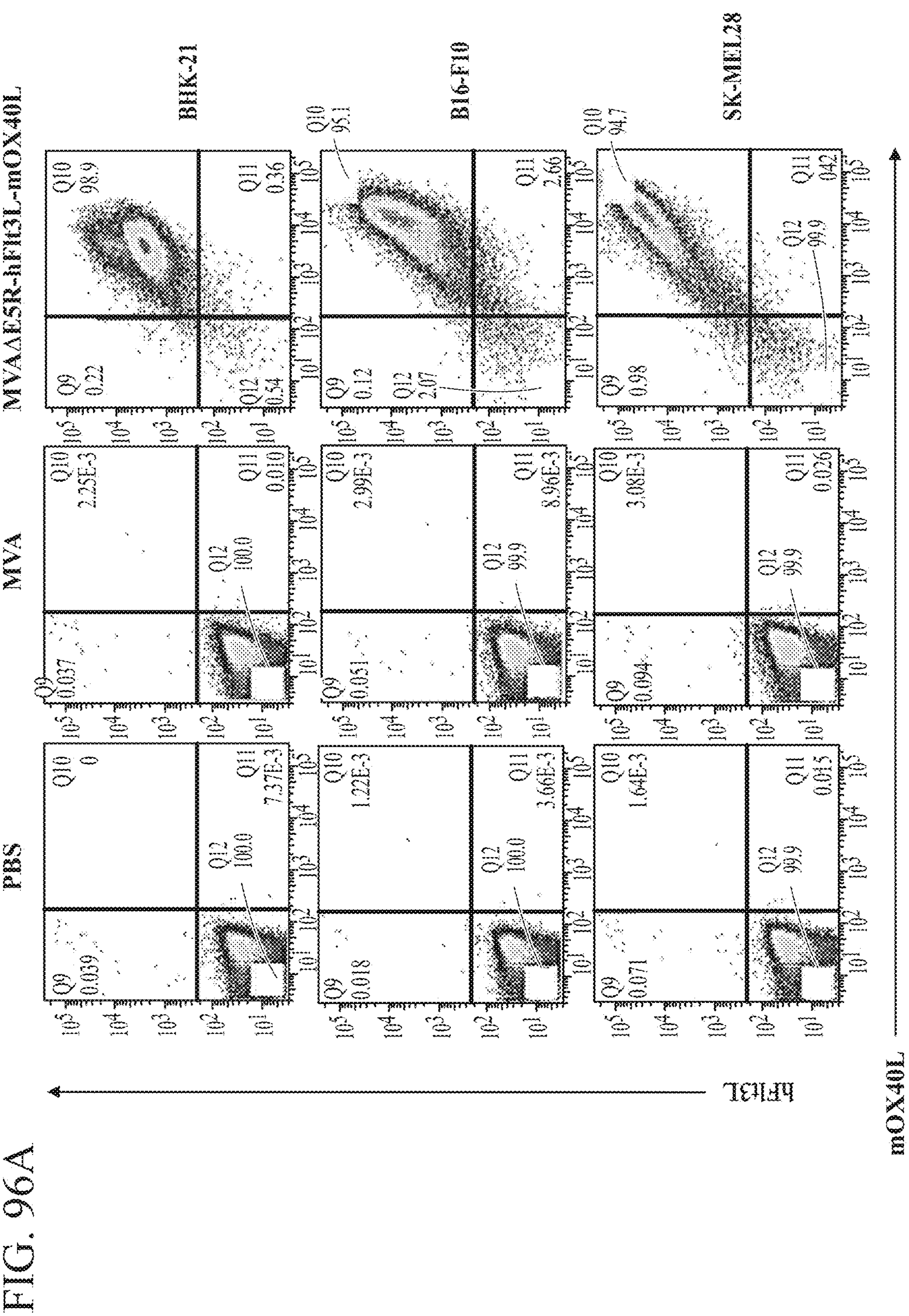
FIGS. 96A and 96B show that MVAΔE5R-hFl3L-mOX40L virus expresses both hFl3L and mOX40L on the surface of infected cells.
Figure 96B:
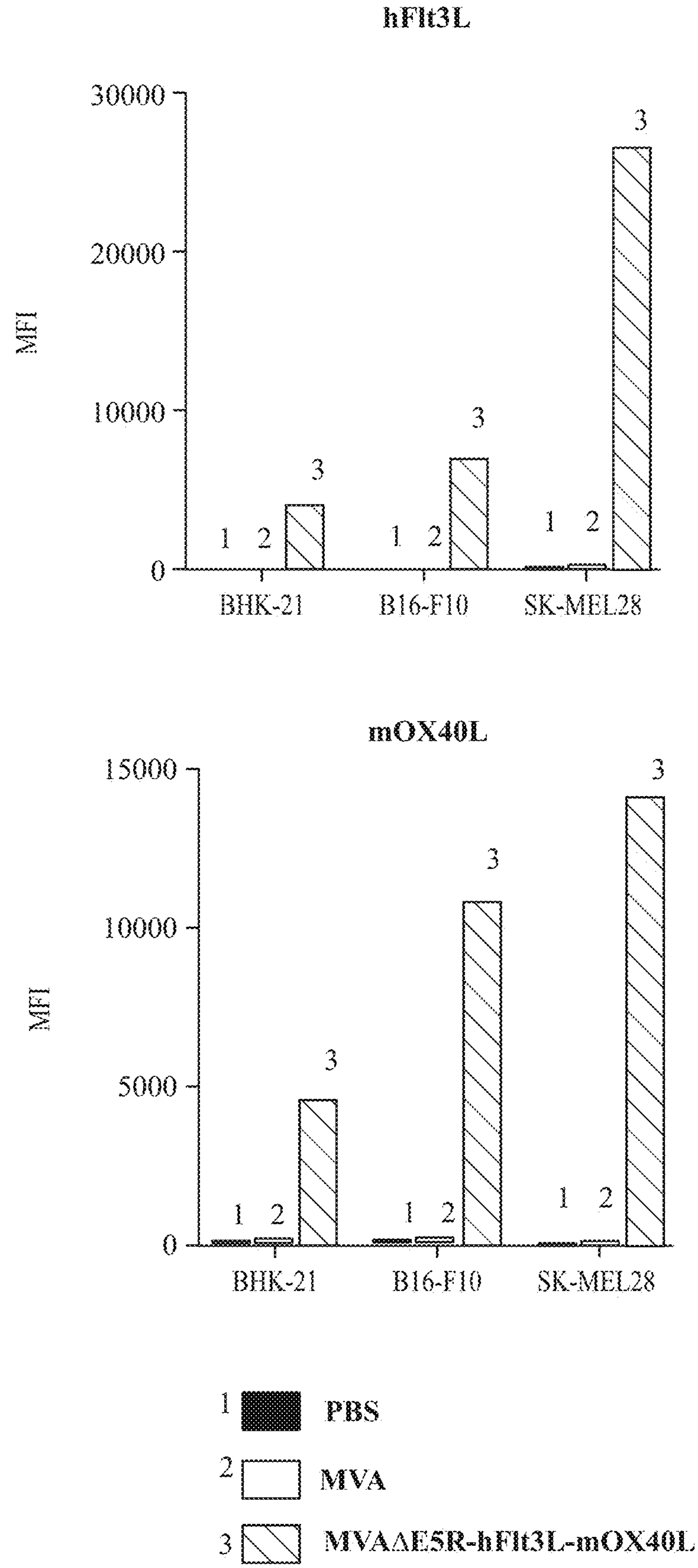

To test whether the recombinant MVAΔE5R-hFl3L-mOX40L virus expresses both hFl3L and mOX40L on the surface of infected cells, the following experiment were performed. BHK-21, murine B16-F10 melanoma cells and human SK-MEL28 melanoma cells were infected with either MVA or MVAΔE5R-hFl3L-mOX40L at MOI 10. No virus mock infection control was included. 24 hours post infection, cells were harvested for surface staining with hFl3L and mOX40L antibodies. Surface expression of hFl3L and mOX40L was analyzed by FACS analysis. FIG. 96A are dot plots of surface expression of hFl3L and mOX40L in BHK-21, B16-F10 and SK-MEL28 cells after infection. FIG.96B are bar plots of mean fluorescence intensity (MFI) of hFl3L and mOX40L expression in BHK-21, B16-F10 and SK-MEL28 cells after infection. The results show that MVAΔE5R-hFl3L-mOX40L expressed mOX40L and hFl3L efficiently in BHK-21, B16-F10 and SK-MEL28 cells at 24 h post infection. Given that MVAΔE5R-hFlt3L-mOX40L does not replicate in B16-F10 or SK-MEL28, the expression of hFl3L and mOX40L on the infected tumor cells was robust.

Example 95: IT injection of MVAΔE5R-hFl3L-mOX40L induces stronger systemic antitumor T-cell immunity compared with MVA, MVAΔE5R or Heat-iMVA.

Figure 97:
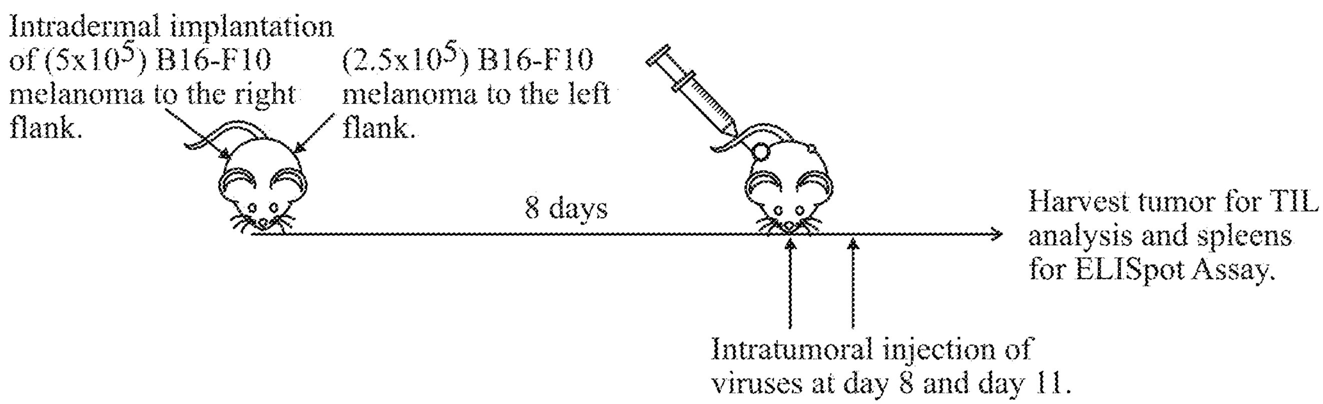
Figure 98A:
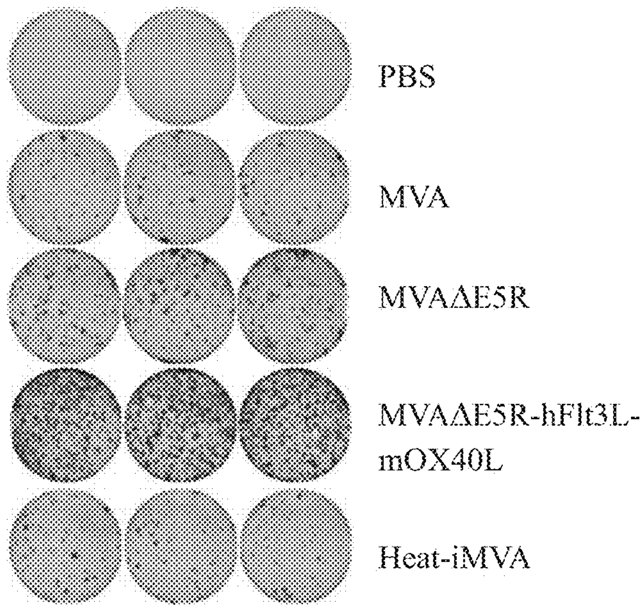
FIGS. 98A-98B. ELISPOT assay was performed by co-culturing irradiated B16-F10 cells (150,000) and splenocytes (1,000,000) in a 96-well plate.
Figure 98B:
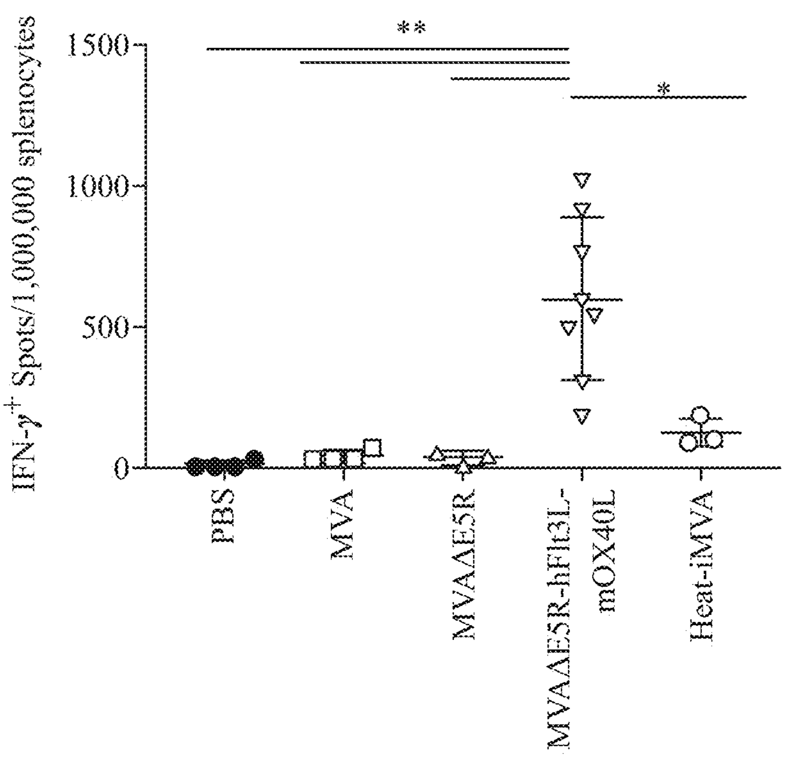
Figure 99A:
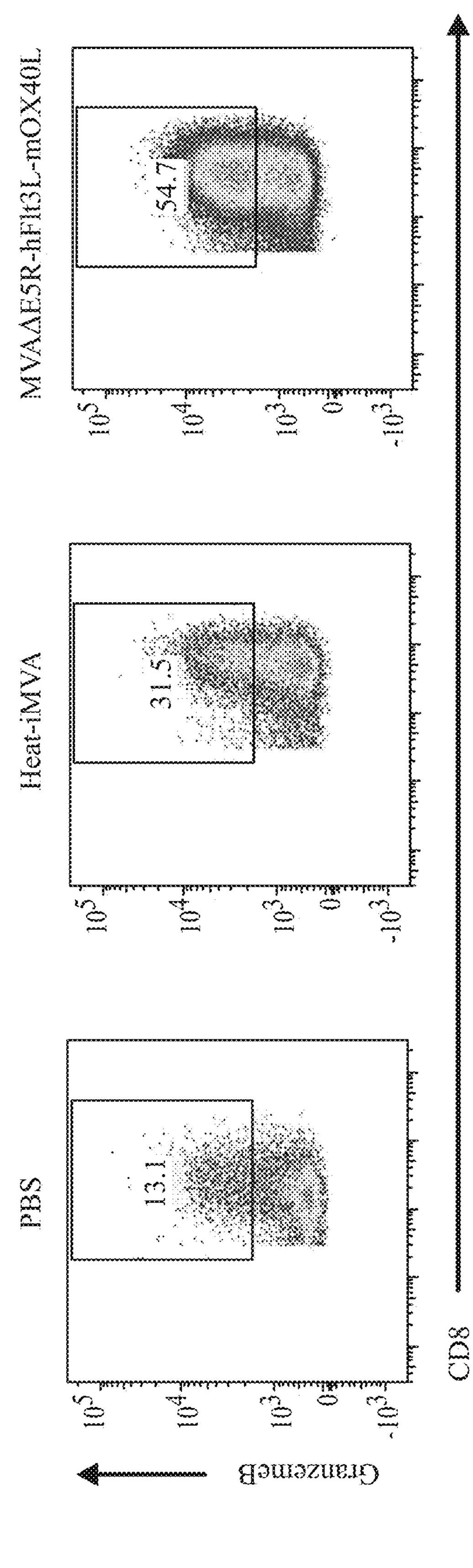
FIGS. 99A-99C.
Figure 99B:
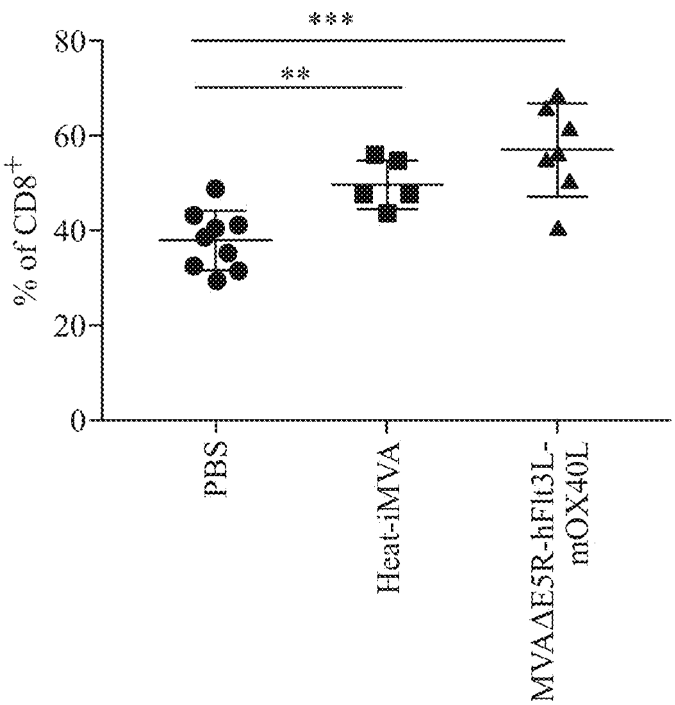
Figure 99C:
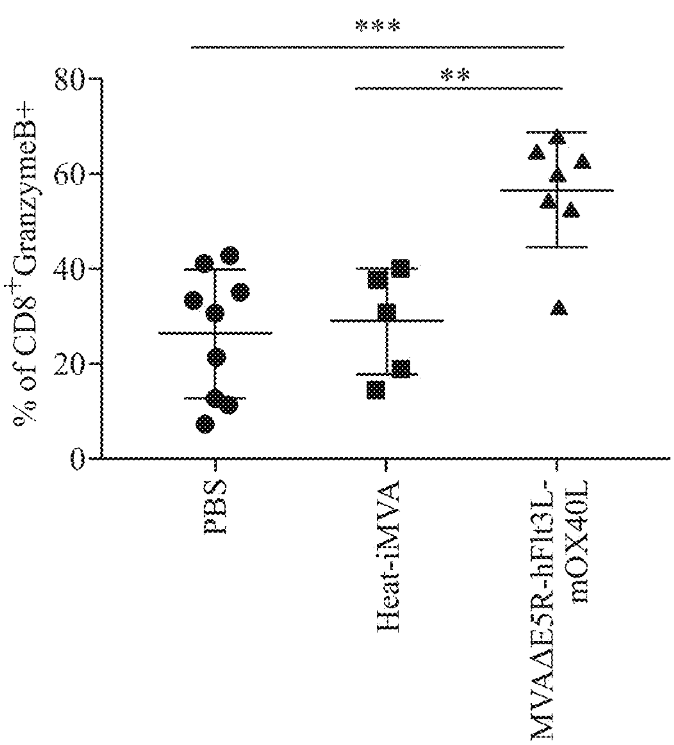

ELISpot was performed to assess the generation of antitumor specific T cells in the spleens of mice treated with MVA, MVAΔE5R, MVAΔE5R-hFlt3L-mOX40L or Heat-iMVA. Briefly, B16-F10 melanoma cells were implanted intradermally into the shaved skin on the right ($5\times10^5$ cells) and left ($2.5\times10^5$ cells) flanks of a C57BL/6J mouse. 8 days post implantation, the larger tumors on the right flank were injected twice per week with $4\times10^7$ pfu of MVA, MVAΔE5R or MVAΔE5R-hFlt3L-mOX40L, or with an equivalent amount of Heat-iMVA. Spleens were harvested for ELISpot analysis (FIG. 97). 1,000,000 splenocytes were cultured with $1.5\times10^5$ irradiated B16-F10 cells overnight at 37° C. in anti-IFN-γ-coated BD ELISpot plate microwells. Splenocytes were stimulated with B16-F10 cells irradiated with an γ-irradiator and IFN-γ secretion was detected with an anti-IFN-γ antibody. FIGS. 98A-98B shows representative images of IFN-$\gamma^+$ spots per 1,000,000 splenocytes from individual mouse treated with either PBS, MVAΔE5R, MVAΔE5R-hFl3L-mOX40L, or Heat-iMVA. FIGS. 99A-99C shows the numbers of IFN$\gamma^+$ spots per 1,000,000 splenocytes from individual mouse in each group treated with either PBS, MVAΔME5R, MVAΔE5R-hFl3L-mOX40L, or Heat-iMVA. These results demonstrate that IT injection of MVAΔE5R-hFl3L-mOX40L is more effective than MVA, MVAΔE5R or Heat-iMVA in generating antitumor T cells in treated mice in a murine B16-F10 melanoma bilateral implantation model.

Example 96: Intratumoral (IT) injection of MVAΔE5R-hFlt3L-mOX40L leads to activation of $CD8^+$ and $CD4^+$ T cells in both injected and non-injected distant tumors in B16-F10 bilateral tumor implantation model.

Figure 100A:
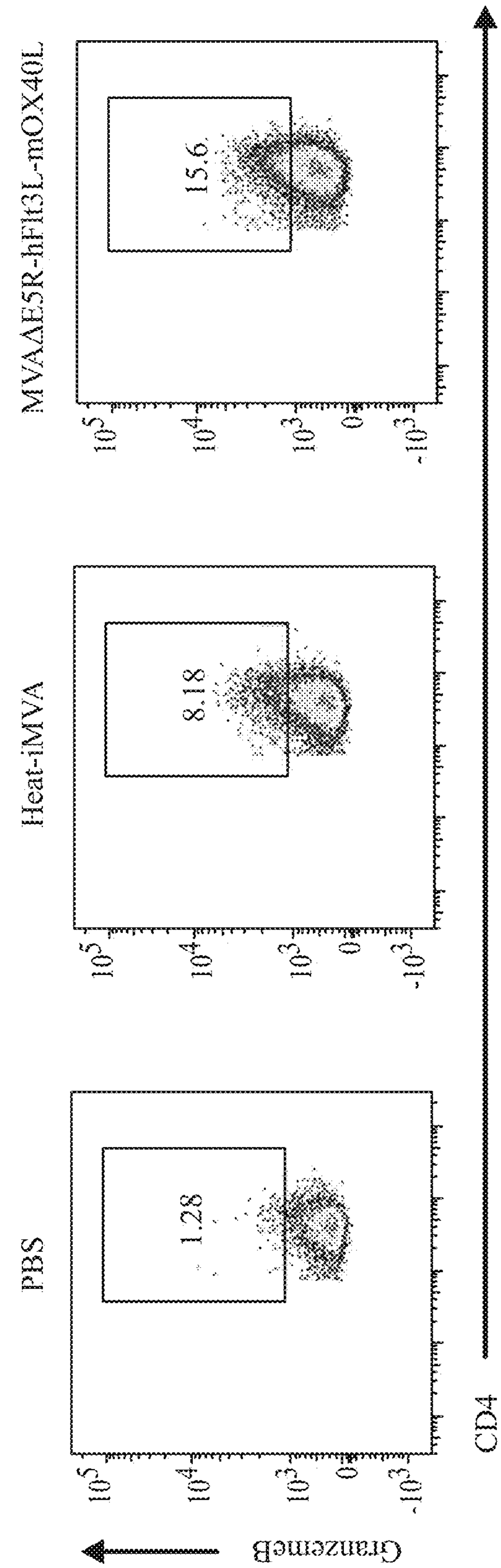
FIGS. 100A-100C.
Figure 100B:
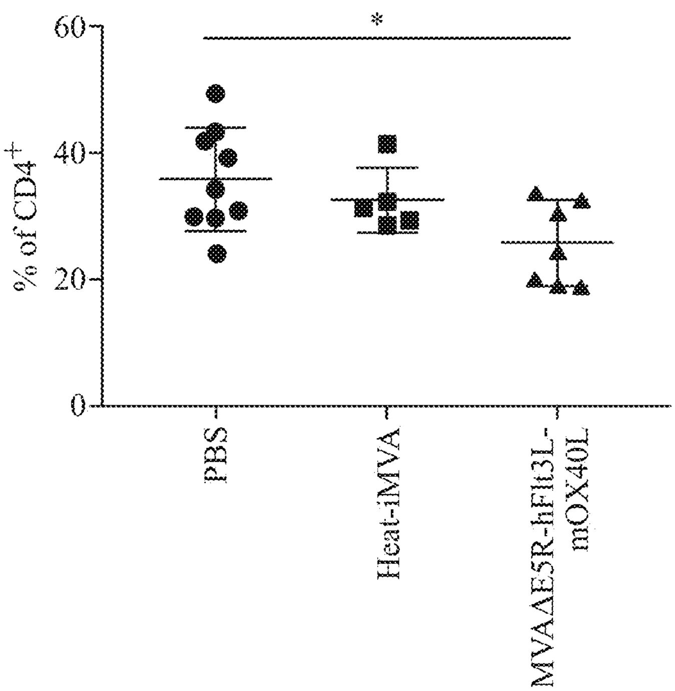
Figure 100C:
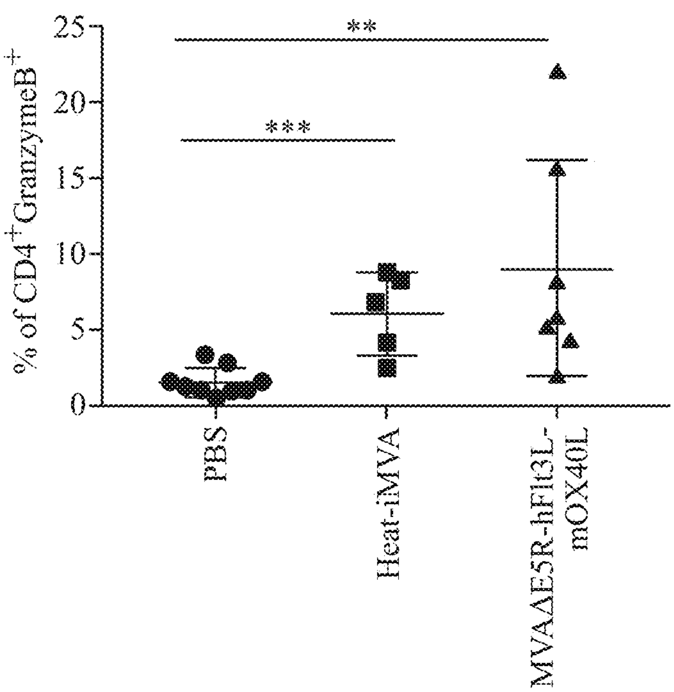
Figure 101A:
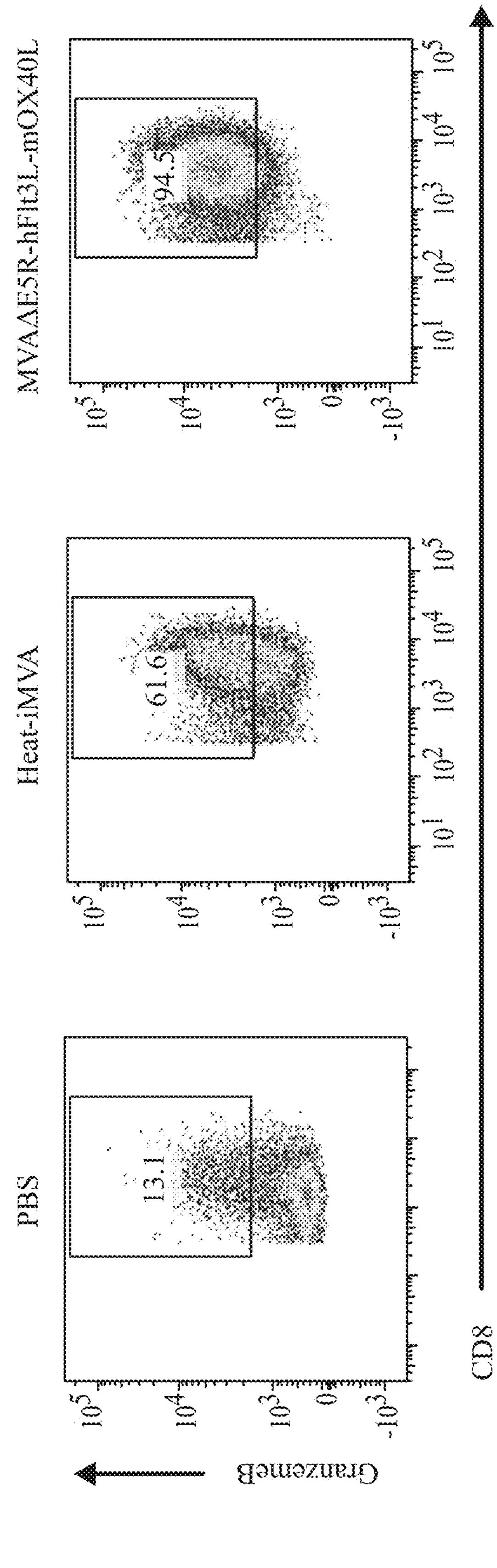
FIGS. 101A-101C.
Figure 101B:
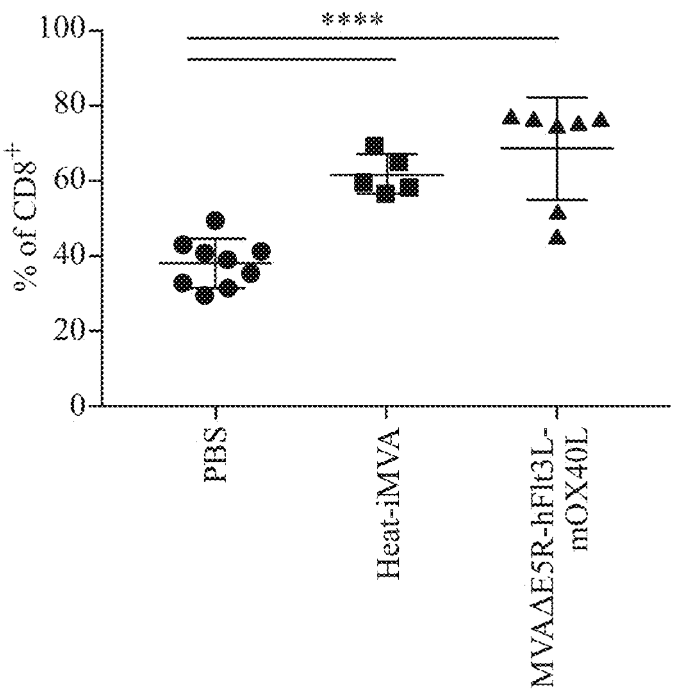
Figure 101C:
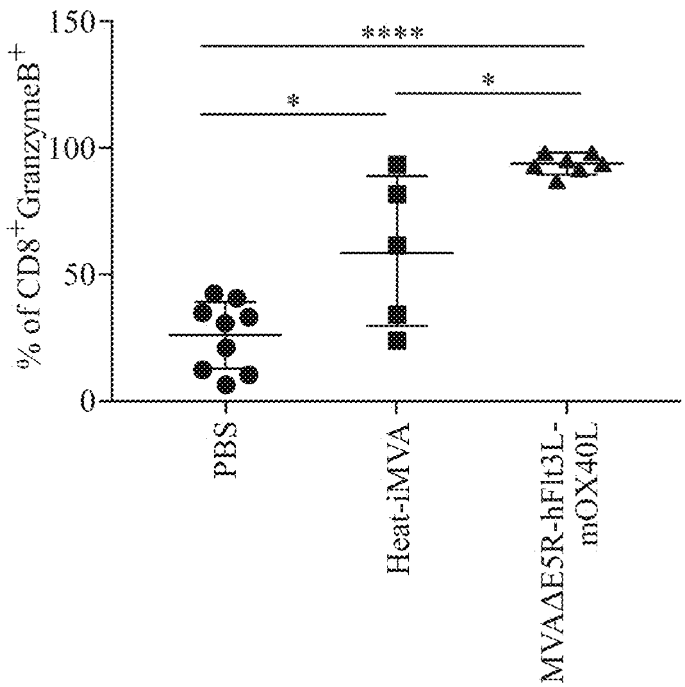
Figure 102A:
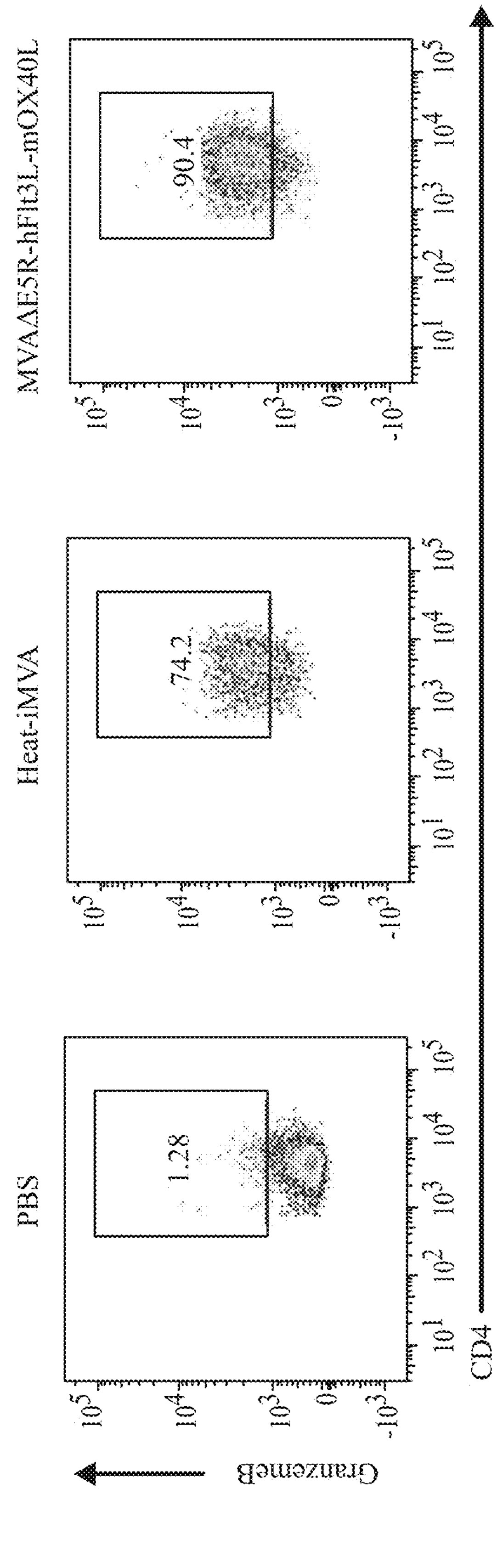
FIGS. 102A-102C.
Figure 102B:
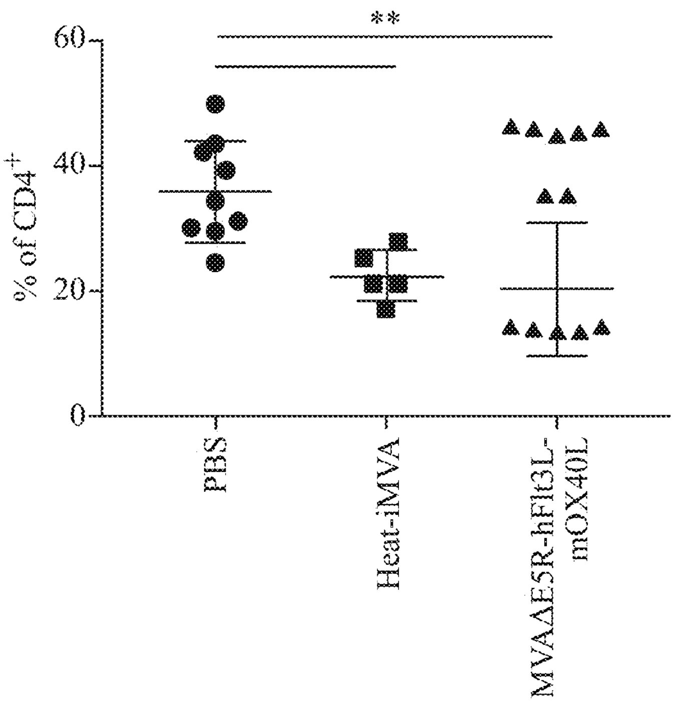
Figure 102C:
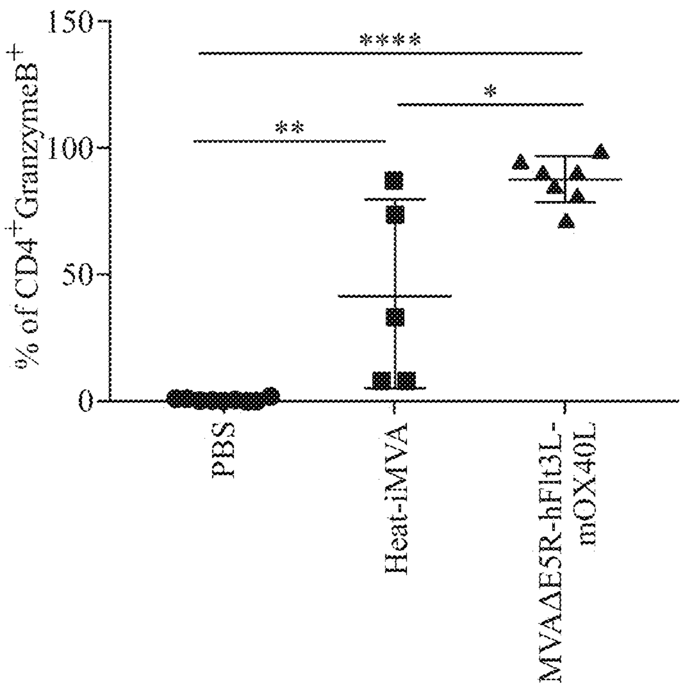
Figure 103A:
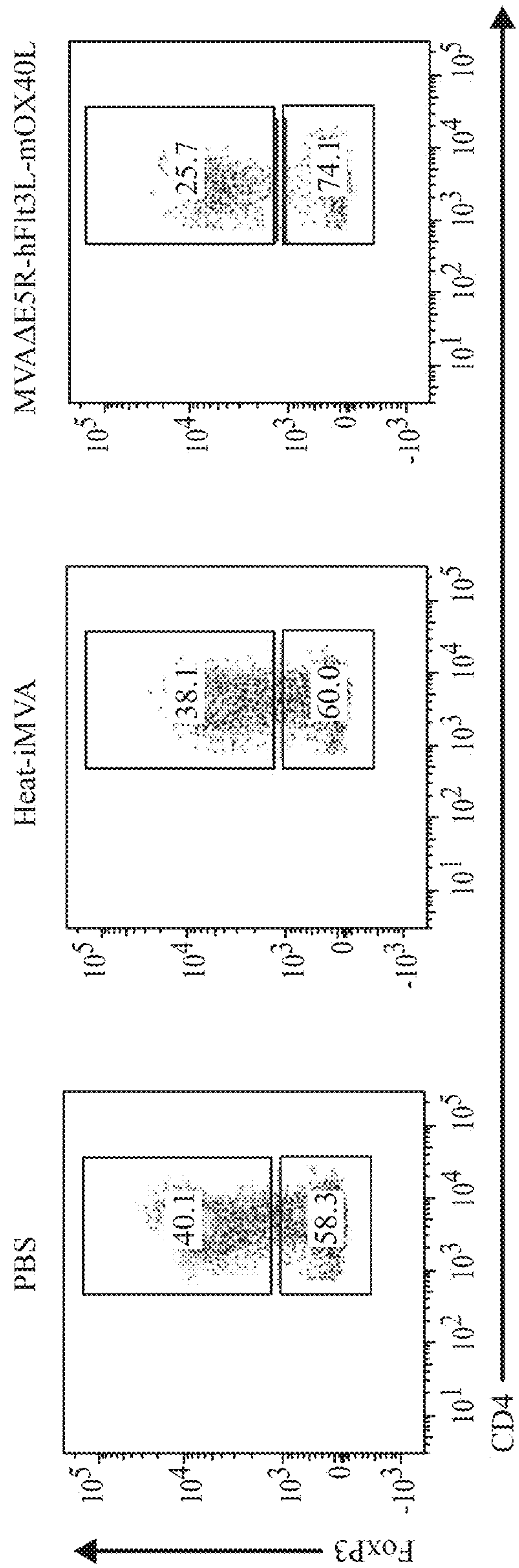
Figure 103B:
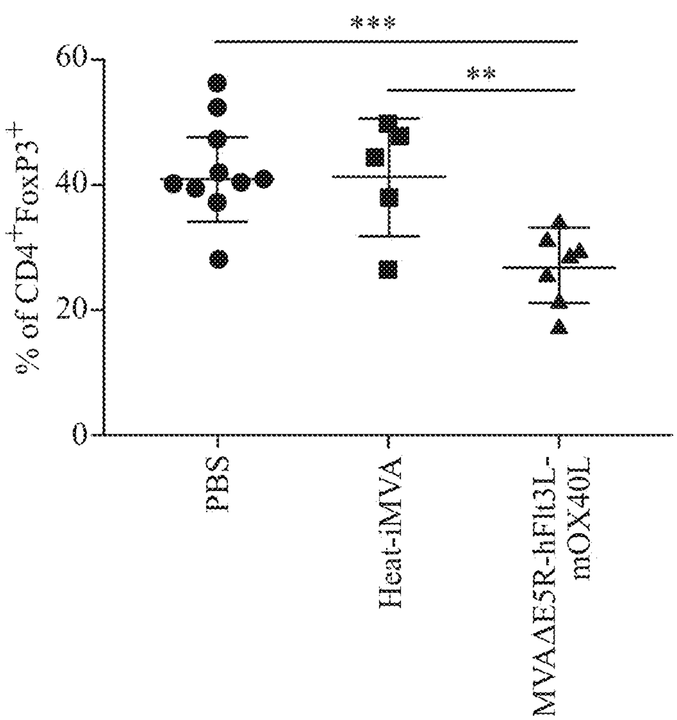
FIG. 103B shows the graph of percentages of $FoxP3^+$ $CD4^+$ T cells out of $CD4^+$ cells. Data are means ±SEM (n=5-9). (P<0.01; *P<0.001,/test).
Figure 103C:
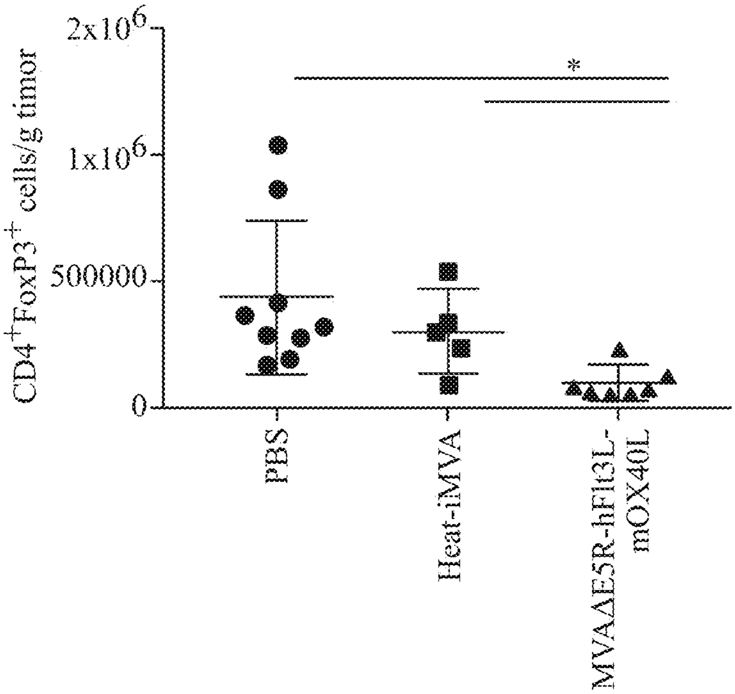
FIG. 103C shows the graph of absolute numbers of $FoxP3^+CD4^+$ T cells per gram of tumor. Data are means ±SEM (n=5-9). (*P<0.05,/test).

To assess whether IT MVAΔE5R-hFl3L-mOX40L results in the generation of local and systemic antitumor immunity, a bilateral B16-F10 tumor implantation model was used as described in Example 3. Two days after the second injection, tumors were harvested and cells were processed for surface labeling with anti-CD3, CD45, CD4, and CD8 antibodies, and also for intracellular Granzyme B staining. The live immune cell infiltrates in the tumors were analyzed by FACS. IT MVAΔE5R-hFl3L-mOX40L resulted in higher percentage of total $CD8^{"}$ T cells as well as Granzyme $B^+$ $CD8^+$ T cells in the non-injected tumors compared with Heat-iMVA (FIGS. 100A-100C). Remarkably, IT MVAΔE5R-hFl3L-mOX40L resulted in higher percentage of total $CD4^+$ T cells as well as Granzyme $B^+$ $CD4^+$ T cells in the non-injected tumors compared with Heat-iMVA (FIGS. 101A-101C). In addition, IT MVAΔE5R-hFl3L-mOX40L also resulted in higher percentage of total $CD8^+$ T cells and Granzyme $B^+$ $CD8^+$ T cells in the injected tumors compared with Heat-iMVA (FIGS. 102A-102C). In addition, IT MVAΔE5R-hFl3L-mOX40L induced higher percentage of Granzyme $B^+$ $CD4^+$ T cells in the injected tumors compared with Heat-iMVA (FIGS. 103A-103C). These results demonstrate that IT MVAΔE5R-hFl3L-mOX40L is more effective than Heat-iMVA in inducing cytotoxic $CD8^+$ T cells and $CD4^+$ T cells within both injected and non-injected tumors, and demonstrate that these viral constructs are useful in methods for treating solid tumors.

Example 97: Intratumoral (IT) injection of MVAΔE5R-hFlt3L-mOX40L leads to reduction of regulatory T cells in injected distant tumors in B16-F10 bilateral tumor implantation model.

Figure 104A:
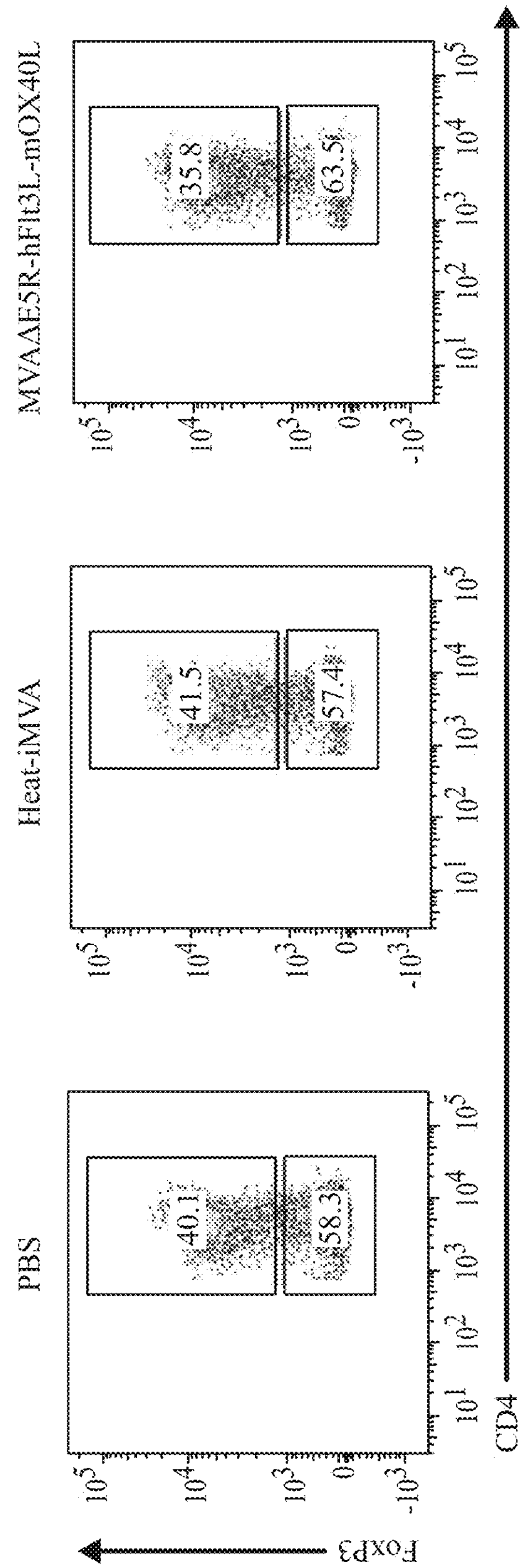
FIG. 104A shows the representative dot plots of $FoxP3^+CD4^+$ cells in the non-injected tumors after treatment with either MVAΔE5R-hFl3L-mOX40L, Heat-iMVA, or PBS.
Figure 104B:
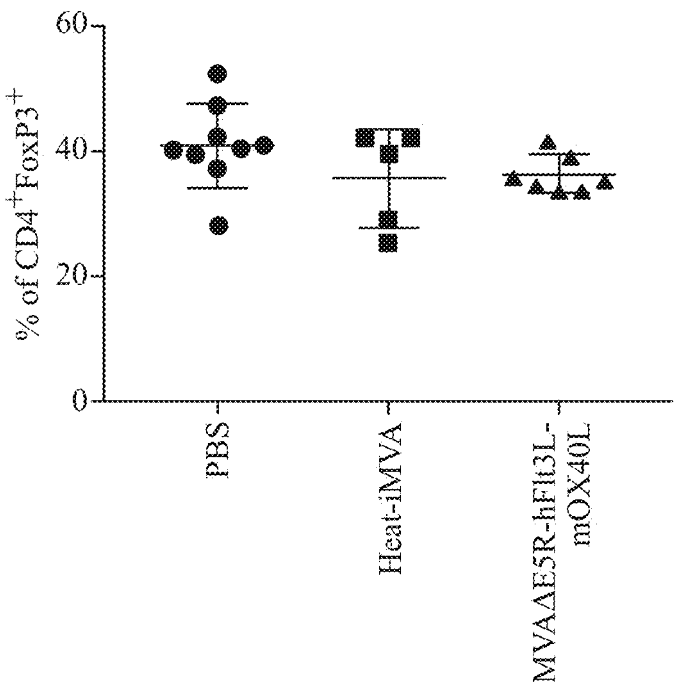
FIG. 104B shows the graph of percentages of $FoxP3^+$ $CD4^+$ T cells out of $CD4^+$ cells. Data are means ±SEM (n=5-9).
Figure 104C:
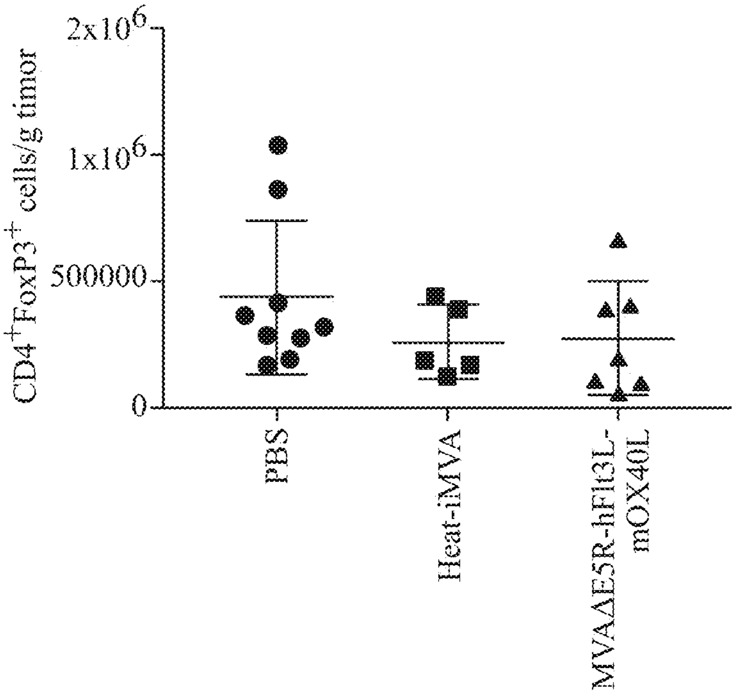
Figure 105A:
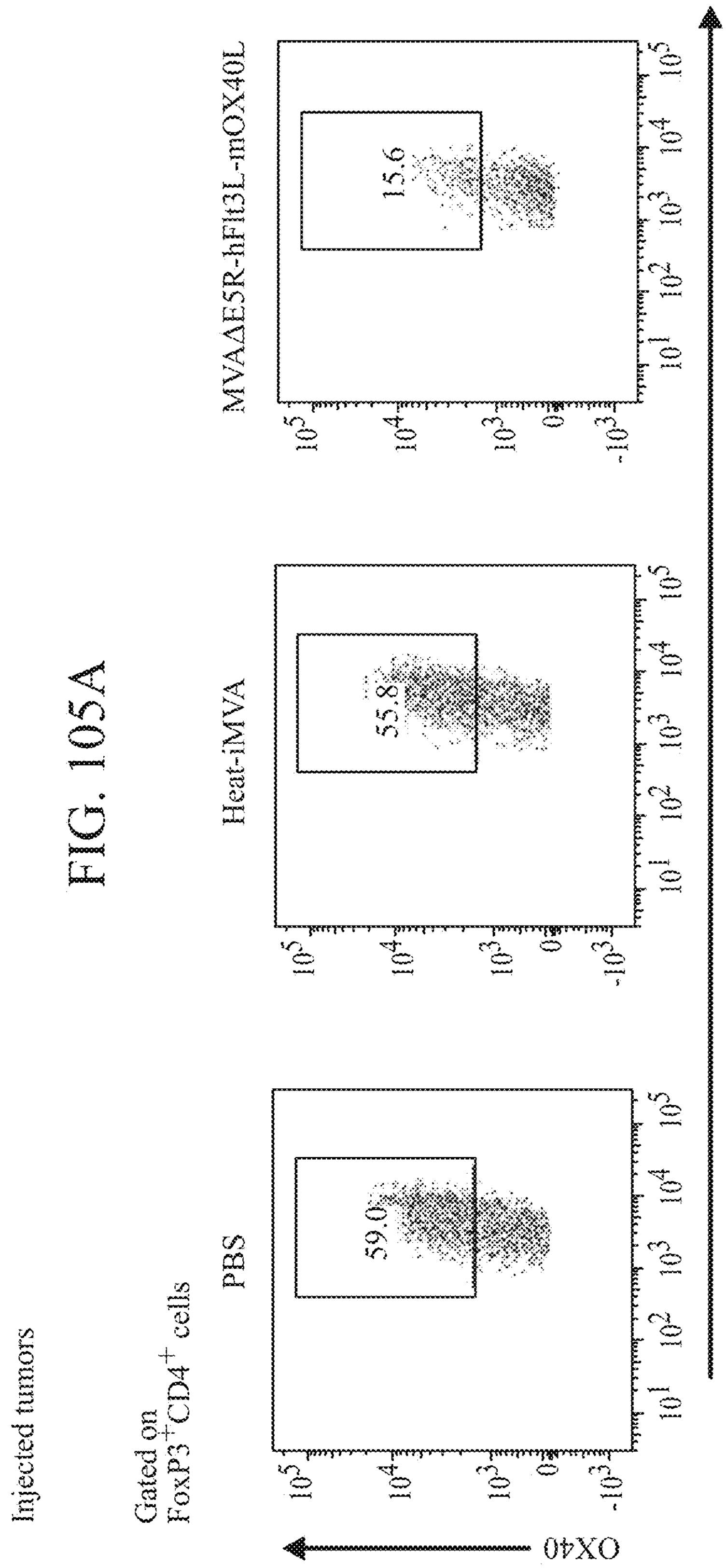
Figure 105B:
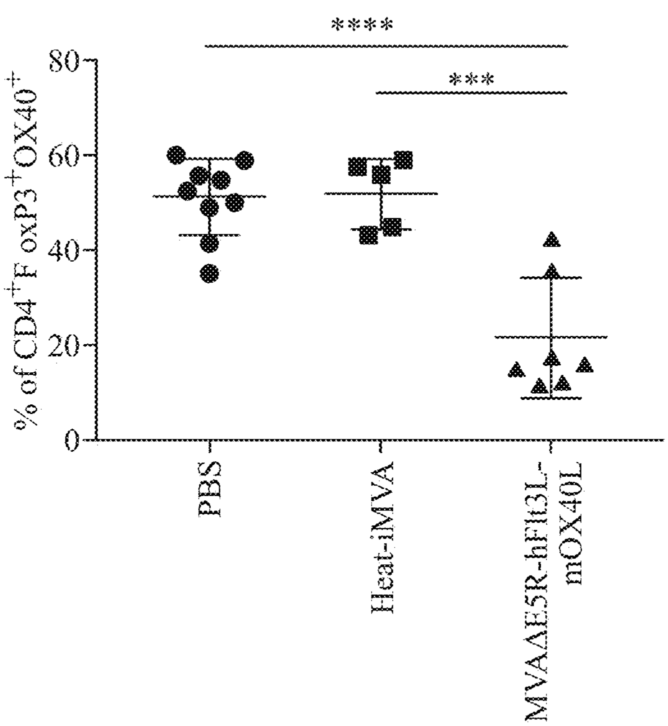
FIG. 105B shows the graph of percentages of $OX40^+FoxP3^-$ $CD4^+$ T cells out of $CD4^+$ cells in the injected tumors. Data are means ±SEM (n=5-9). (P<0.01; *P<0.001,/test).
Figure 105C:
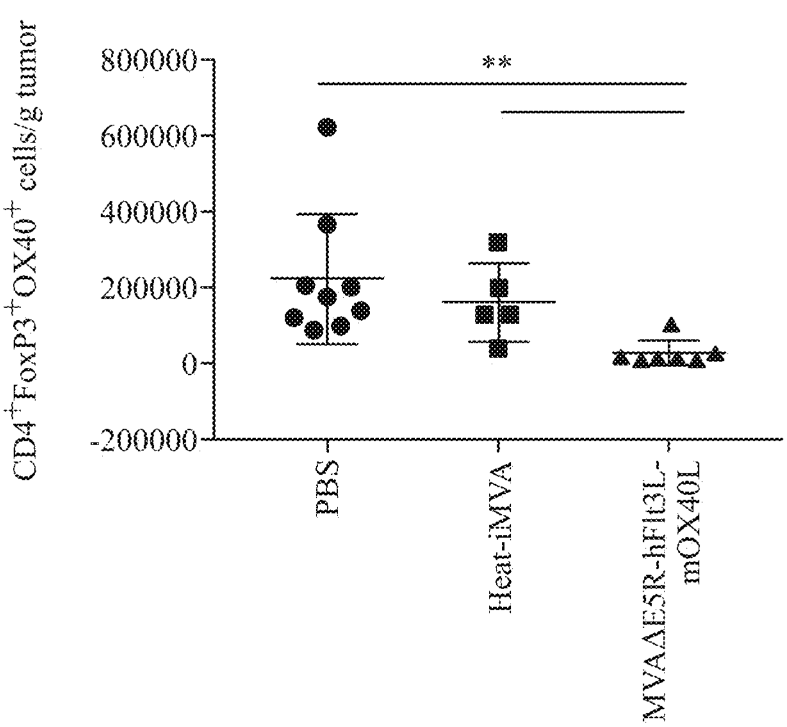
FIG. 105C shows the graph of absolute numbers of $OX40^+$ $FoxP3^+CD4^+$ T cells per gram of tumor. Data are means ±SEM (n=5-9). (*P<0.05,/test).
Figure 106A:
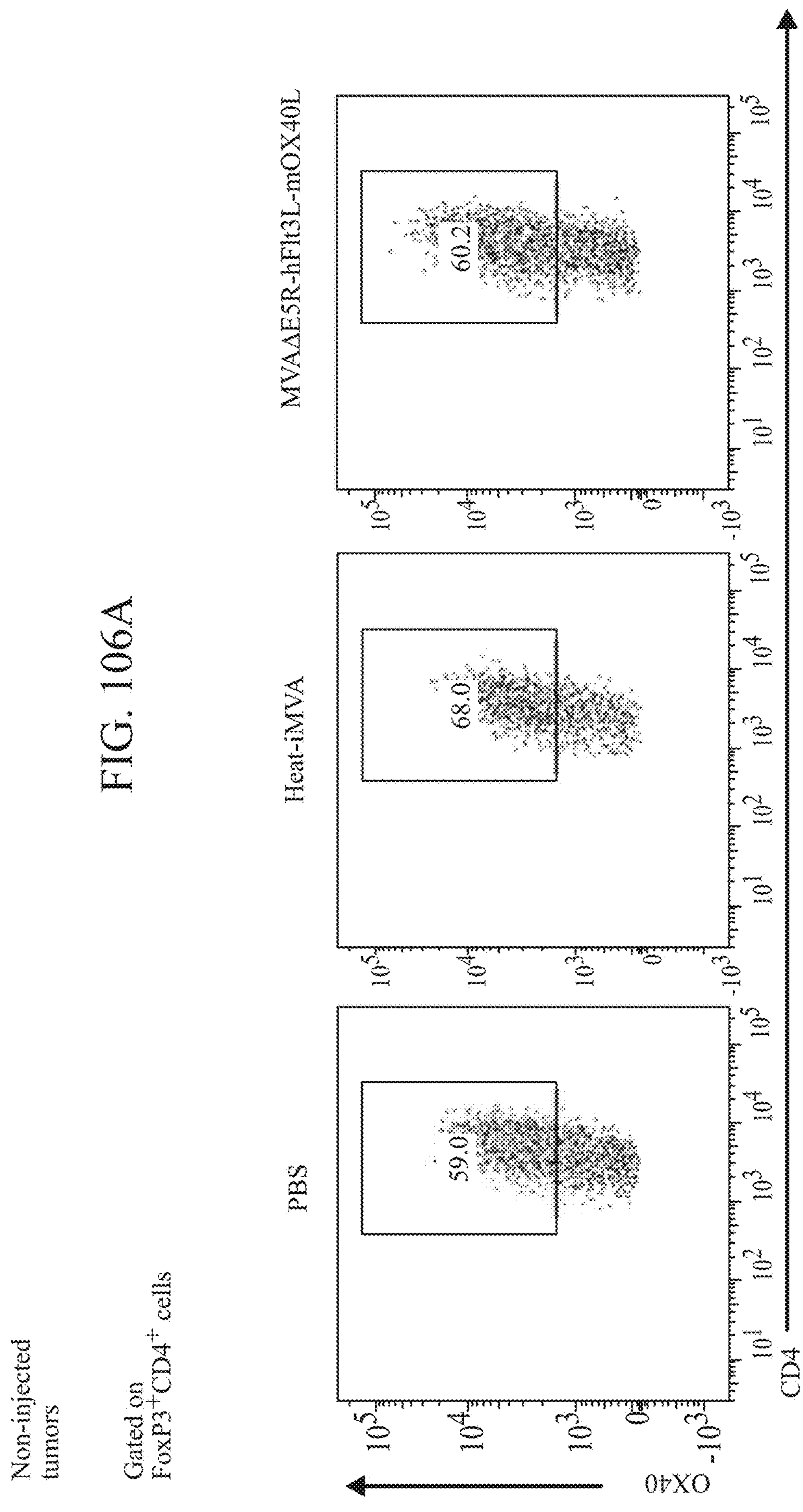
FIG. 106A shows the representative dot plots of $OX40^+$ $FoxP3^+CD4^+$ cells in the non-injected tumors after treatment with either MVAΔE5R-hFl3L-mOX40L, Heat-iMVA, or PBS.
Figure 106B:
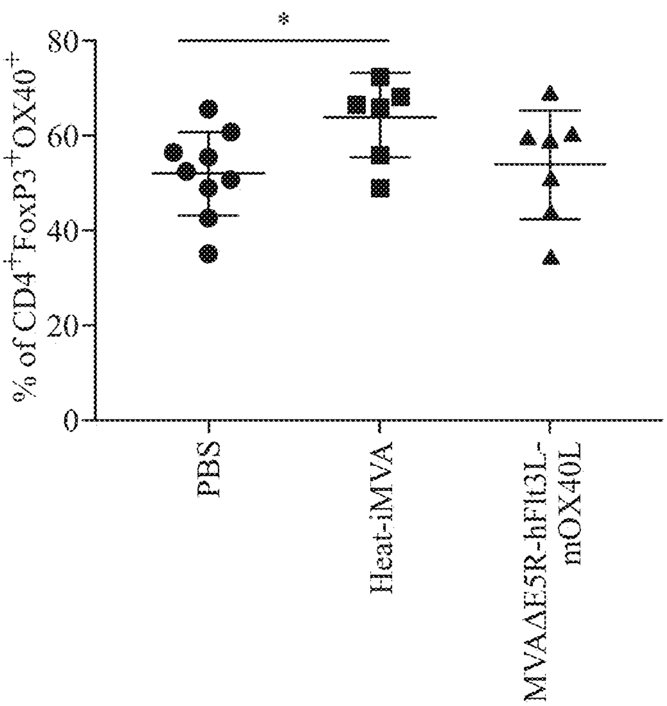
FIG. 106B shows the graph of percentages of $OX40^+$ $FoxP3^+CD4^+$ T cells out of $CD4^+$ cells. Data are means ±SEM (n=5-9).
Figure 106C:
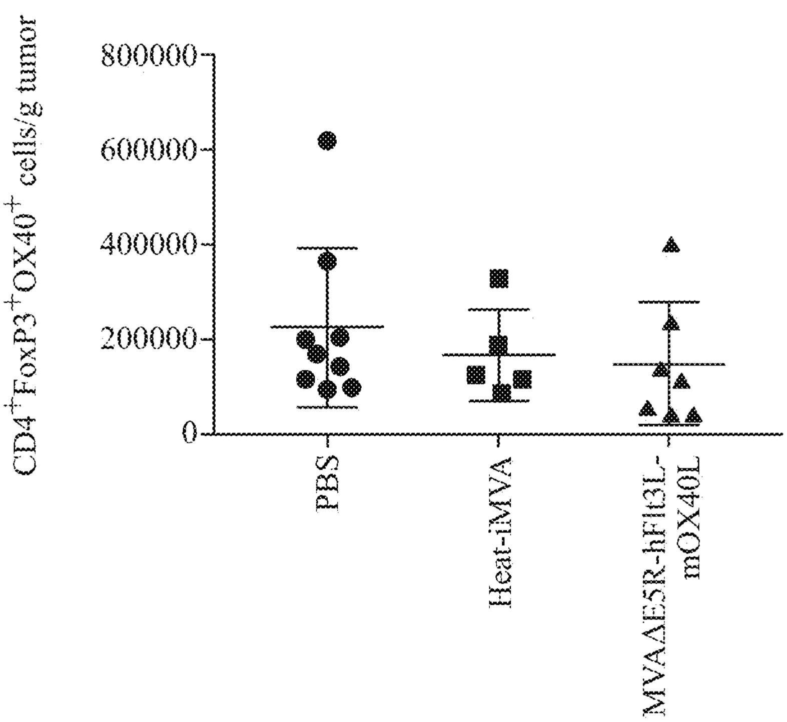
FIG. 106C shows the graph of absolute numbers of $OX40^+FoxP3^+CD4^+$ T cells per gram of tumor. Data are means ±SEM (n=5-9).
Figure 107A:
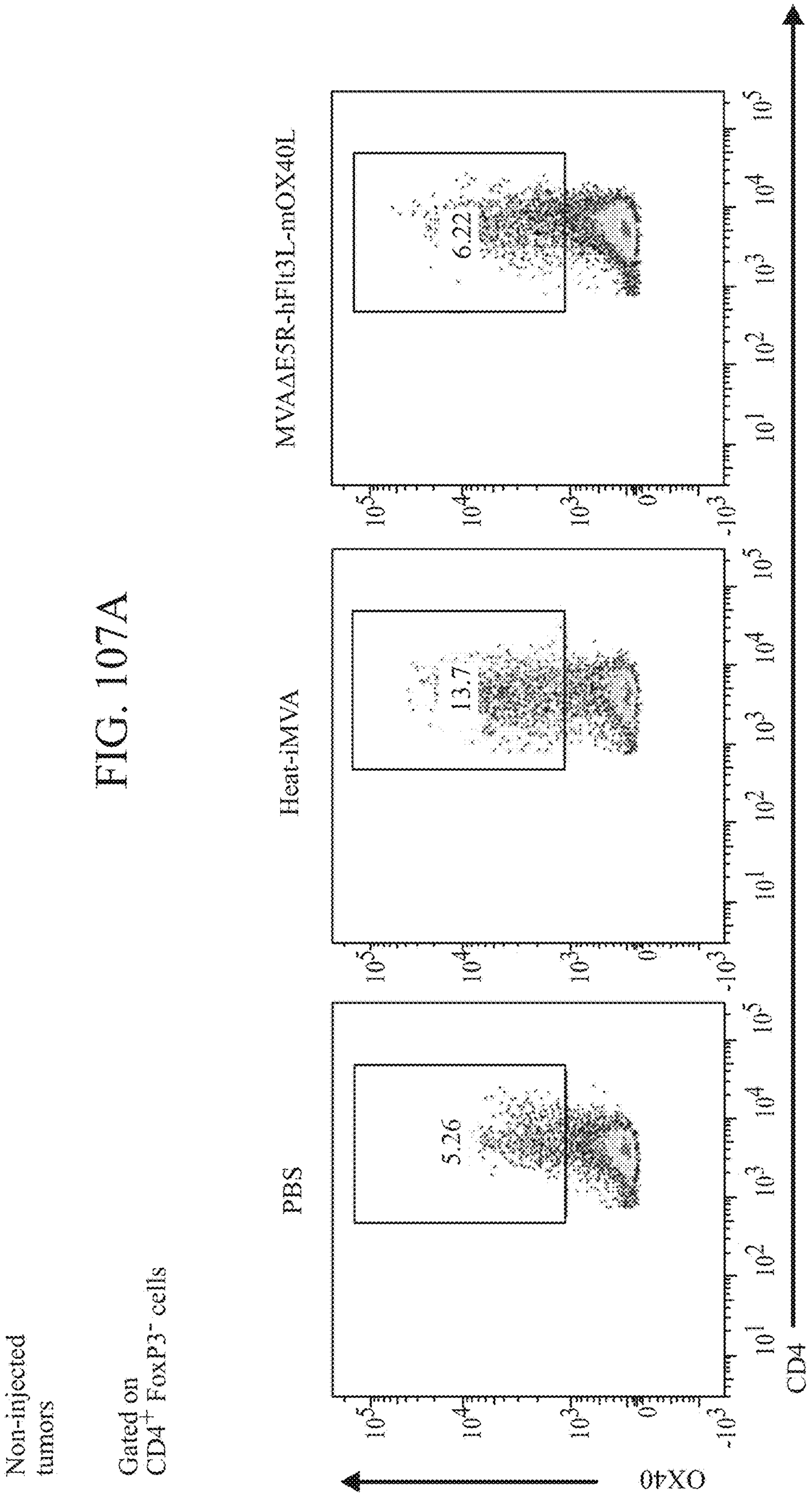
FIG. 107A shows the representative dot plots of $OX40^+$ $FoxP3^+CD4^+$ cells in the non-injected tumors after treatment with either MVAΔE5R-hFl3L-mOX40L, Heat-iMVA, or PBS.
Figure 107B:
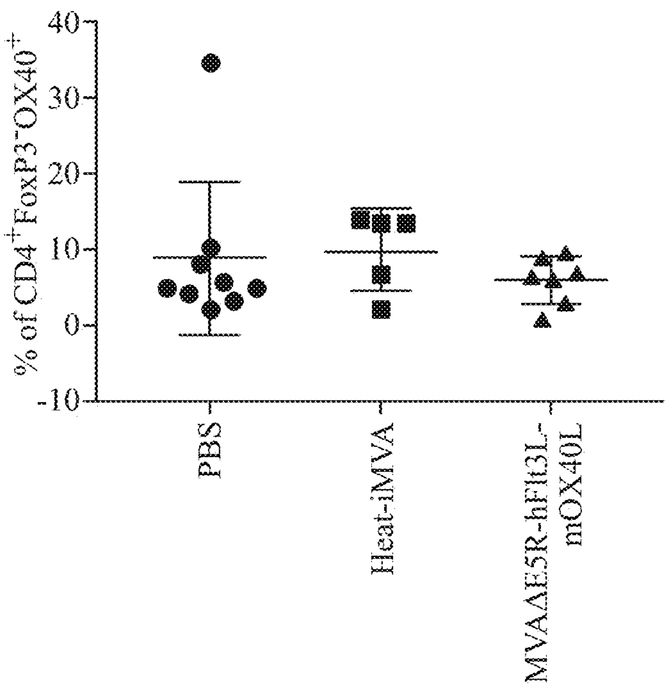
FIG. 107B shows the graph of percentages of $OX40^+$ $FoxP3^+CD4^+$ T cells out of $CD4^+$ cells. Data are means ±SEM (n=5-9).
Figure 107C:
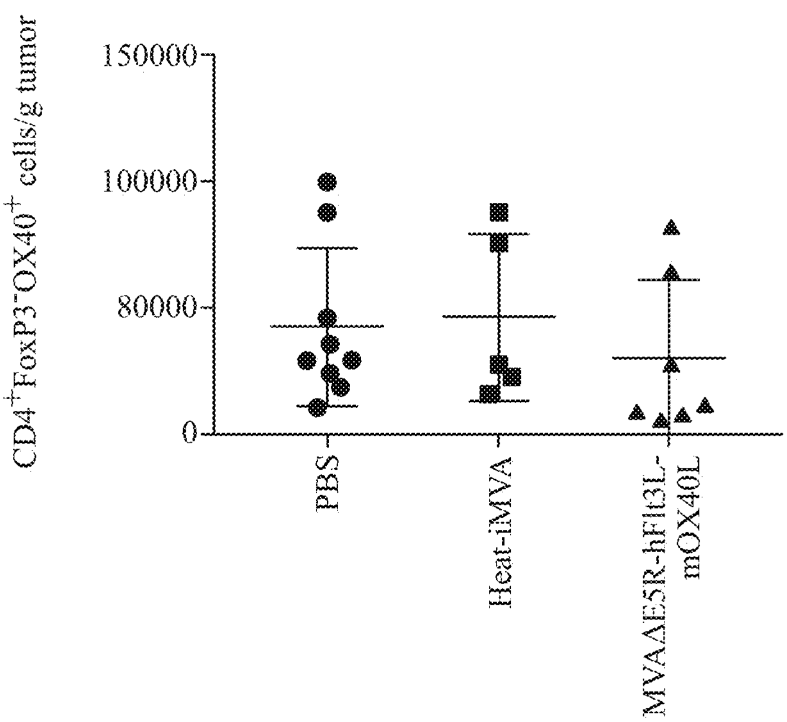
FIG. 107C shows the graph of absolute numbers of $OX40^+FoxP3^+CD4^+$ T cells per gram of tumor. Data are means ±SEM (n=5-9).
Figure 108:
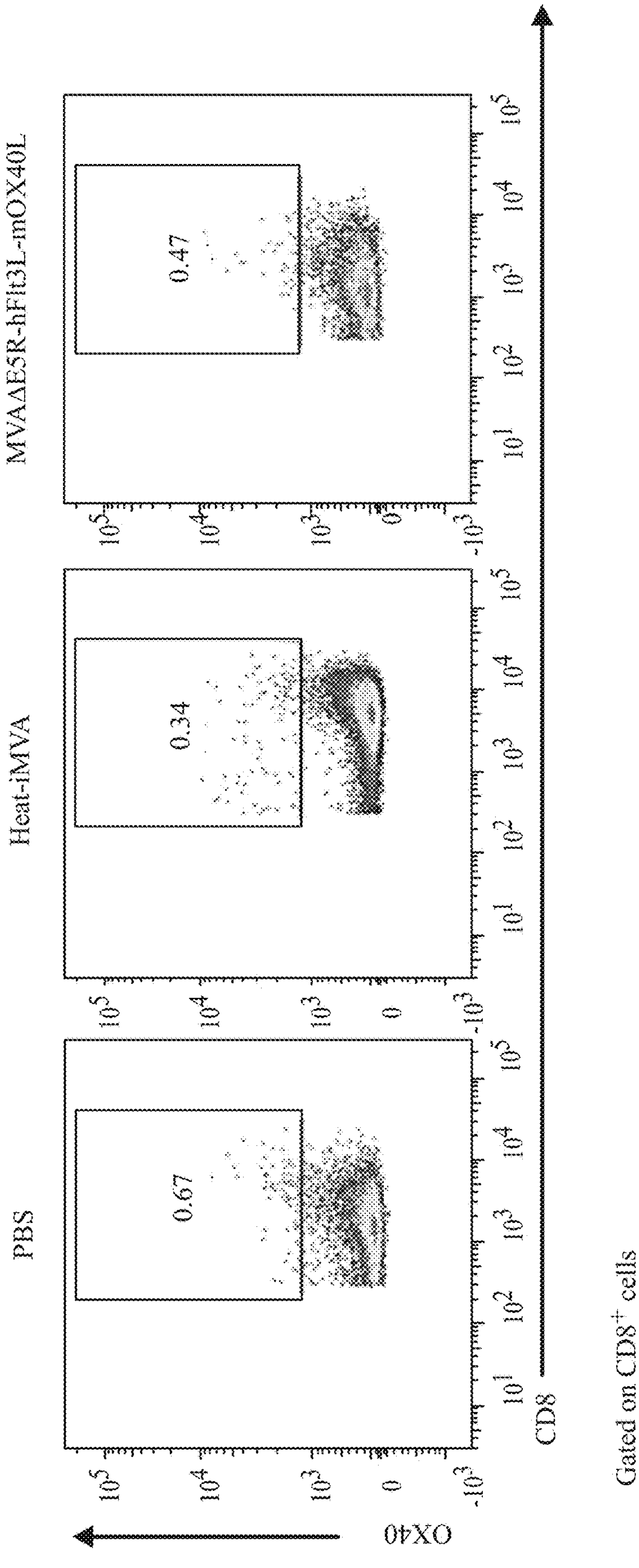

To assess whether IT MVAΔE5R-hFl3L-mOX40L affected tumor infiltrating regulatory T cells, a bilateral B16-F10 tumor implantation model was used as described in Example 95. Two days after the second injection, tumors were harvested and cells were processed for surface labeling with anti-CD3, CD45, CD4, CD8 and OX40 antibodies, and also for intracellular FoxP3 staining. The live immune cell infiltrates in the tumors were analyzed by FACS. IT MVAΔE5R-hFl3L-mOX40L resulted in reduced percentage and absolute number of $CD4^+FoxP3^{30}$ T cells in the injected tumors (FIGs.103A-103C). There was no significant difference of the percentage and absolute number of Tregs in the non-injected tumors among PBS, Heat-iMVA and IT MVAΔE5R-hFl3L-mOX40L treated groups (FIGS. 104A-104C). OX40, the receptor of OX40L was highly expressed on $CD4^+FoxP3^+$ T cells (FIGS. 105A-105C). IT MVAΔE5R-hFl3L-mOX40L resulted in reduced percentage and absolute number $OX40^+CD4^+FoxP3^+$ T cells in the injected tumors (FIGS. 105A-105C), which was not observed in non-injected tumors (FIGS. 106A-106C). OX40 was not highly expressed in $CD4^+FoxP3^+$ T cells (FIGS. 107A-107C) and $CD8^+$ T cells (FIG. 108). These results demonstrate that IT injection of MVAΔE5R-hFl3L-mOX40L reduces $OX40^+CD4^+FoxP3^+$ T cells in the injected tumors, and is useful in methods for treating solid tumors.

Example 98: Reduction of regulatory T cells (Tregs) in injected distant tumors by intratumoral (IT) delivery of MVAΔE5R-hFlt3L-mOX40L is dependent on OX40L expression by MVAΔE5R-hFlt3L-mOX40L.

Figure 109A:
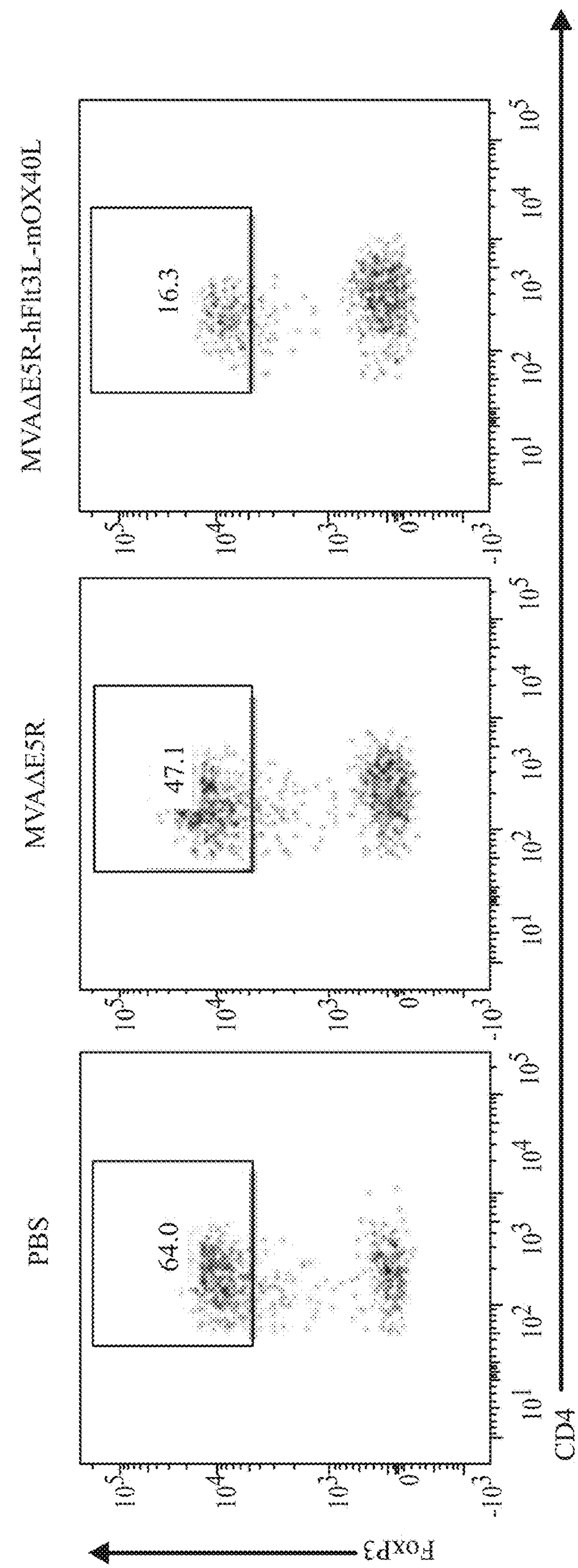
Figure 109B:
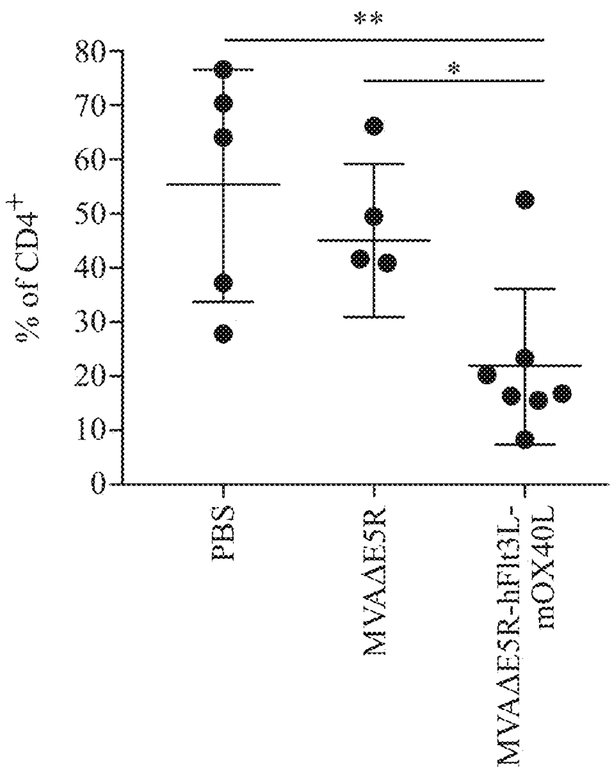
Figure 109C:
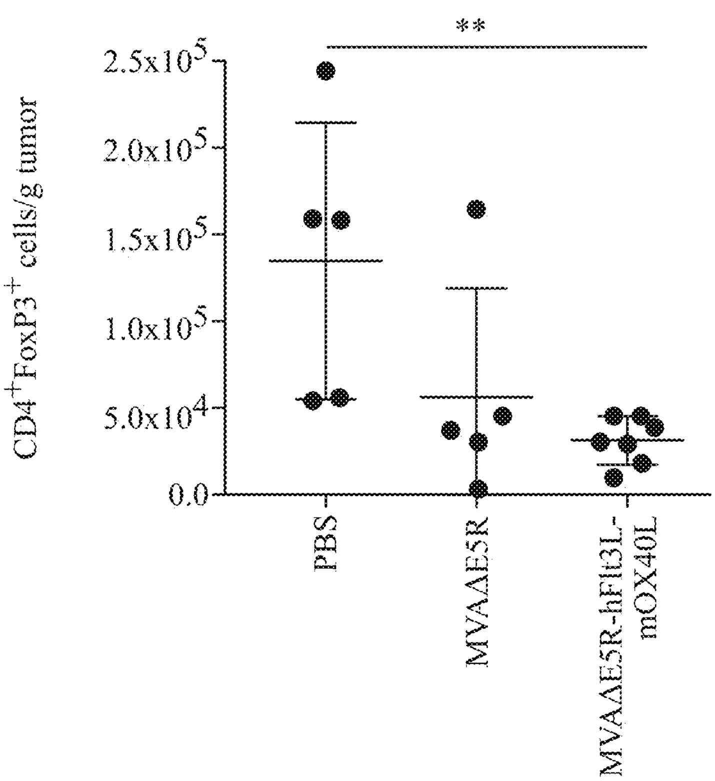

To assess whether the reduction of Tregs by IT injection of MVAΔE5R-hFl3L-mOX40L was dependent on mOX40L expression, a bilateral B16-F10 tumor implantation model was used and compared the efficiency of reduction by IT delivery of MVAΔE5R-hFl3L-mOX40L vs. MVAΔE5R. Briefly, B16-F10 melanoma cells were implanted intradermally into the shaved skin on the right ($5\times10^5$ cells) and left ($2.5\times10^5$ cells) flanks of a wild C57BL/6J. Eight days post implantation, the larger tumors on the right flank were injected twice per week with $4\times10^7$ pfu of MVAΔE5R or MVAΔE5R-hFl3L-mOX40L, or PBS. Two days post second injection, tumors were harvested and cells were processed for surface labeling with anti-CD3, CD45, CD4 and CD8 antibodies, and also for intracellular FoxP3 staining. The live immune cell infiltrates in the tumors were analyzed by FACS. In the injected tumors, IT injection of MVAΔE5R-hFl3L-mOX40L resulted in significantly reduced percentage and absolute numbers of $CD4^+FoxP3^+$ T cells in the injected tumors compared with PBS (FIGS. 109A-109C). By contrast, IT injection of MVAΔE5R did not significantly affect the percentage of $CD4^+FoxP3^+$ T cells (FIGS. 109A-109C). These results demonstrate that depletion of Tregs in in the injected tumors by IT injection of MVAΔE5R-hFl3L-mOX40L is dependent on OX40L expression by the recombinant virus.

Example 99: Intratumoral (IT) injection of MVAΔE5R-hFlt3L-mOX40L leads to stronger activation of $CD8^+$ and $CD4^+$ T cells in the injected tumors in $OX40^{-/-}$ compared with WT mice in B16-F10 bilateral tumor implantation model.

Figure 110:
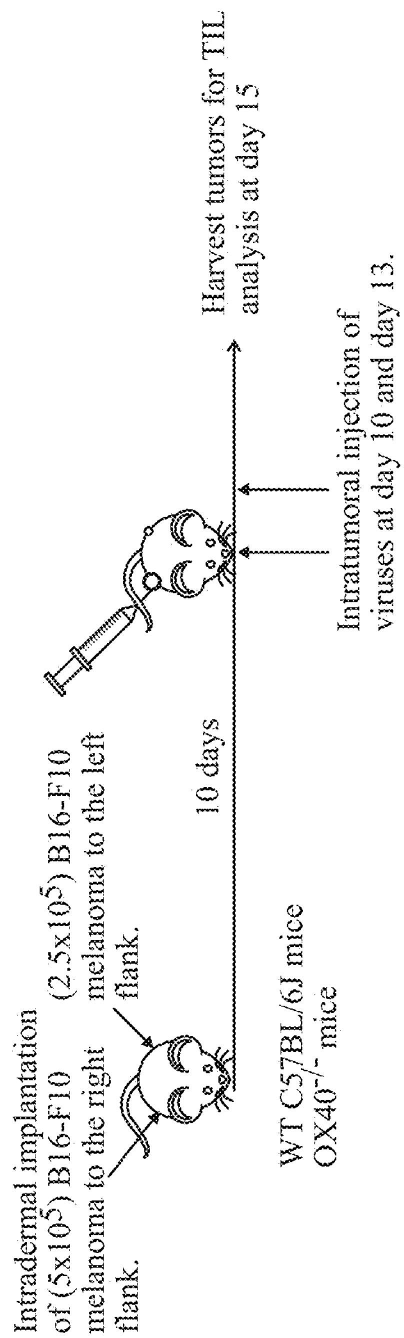
Figure 111A:
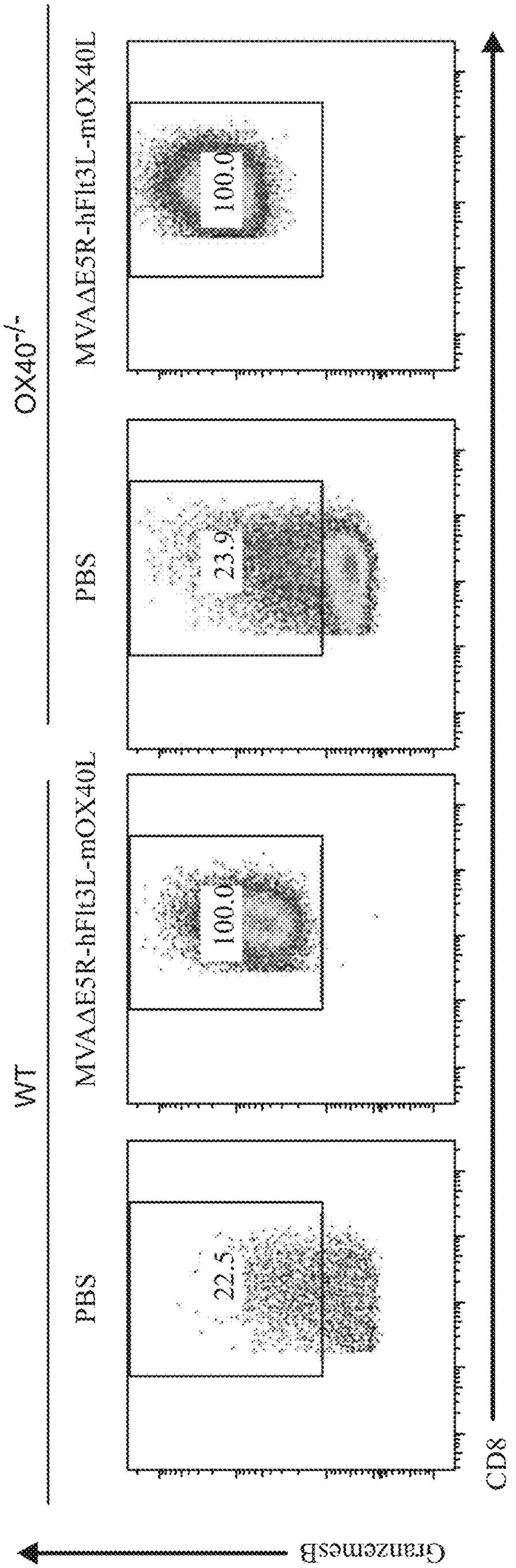
FIG. 111A shows the representative dot plots of Granzyme $B^+$ $CD8^+$ T cells in the injected tumors from WT and $OX40^{-/-}$ mice after treatment with either MVAΔE5R-hFl3L-mOX40L or PBS.
Figure 111B:
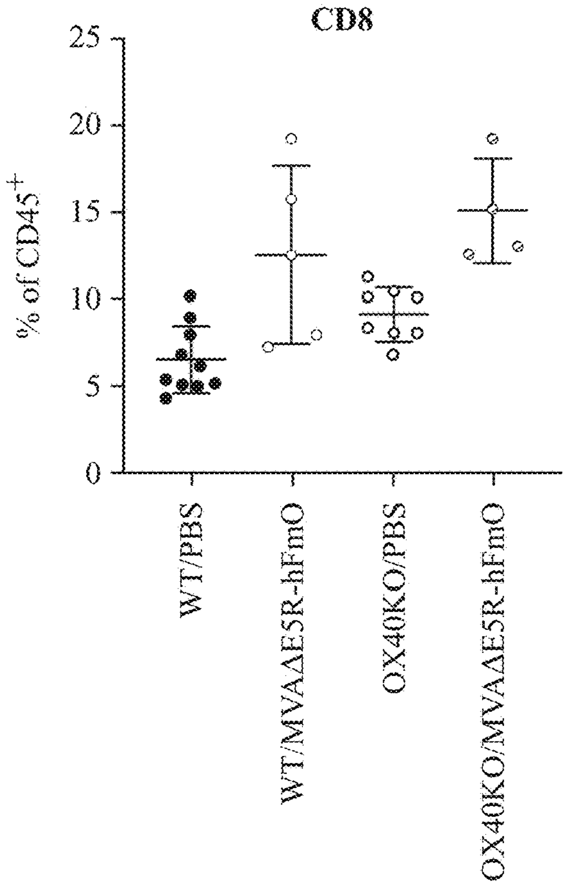
FIG. 111B shows the graph of percentages of $CD8^+$ T cells out of $CD3^+$ cells. Data are means ±SEM (n=4-10).
Figure 111C:
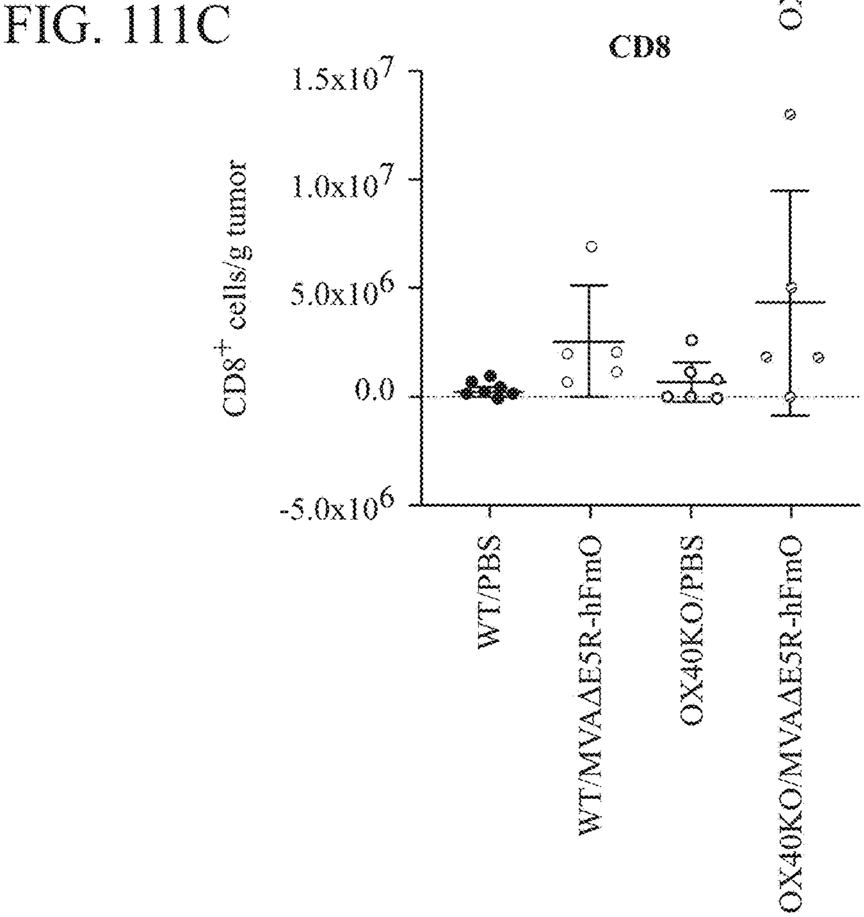
FIG. 111C shows the graph of absolute numbers of $CD8^+$ T cells per gram of tumor. Data are means ±SEM (n=4-10).
Figure 111D:
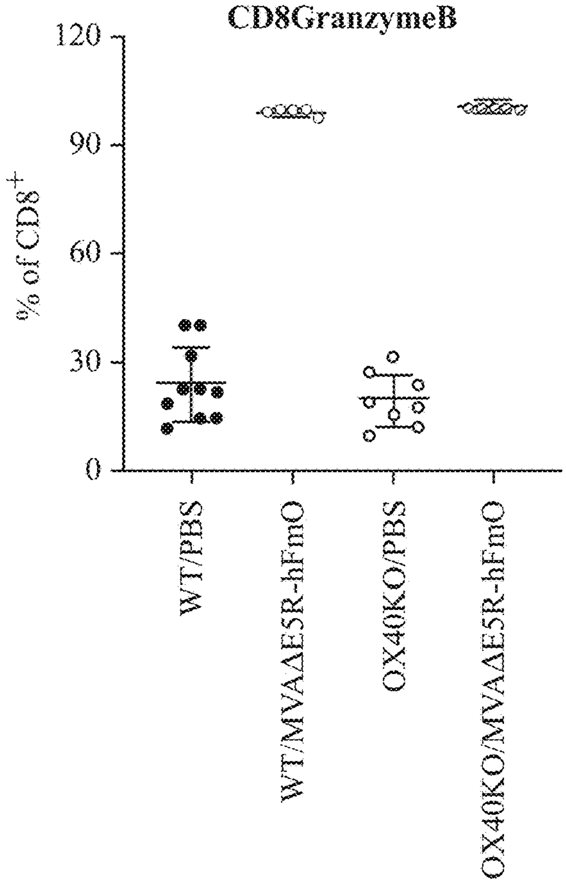
FIG. 111D shows the graph of percentages of Granzyme $B^+$ $CD8^+$ T cells out of $CD8^+$ cells. Data are means ±SEM (n=4-10).
Figure 111E:
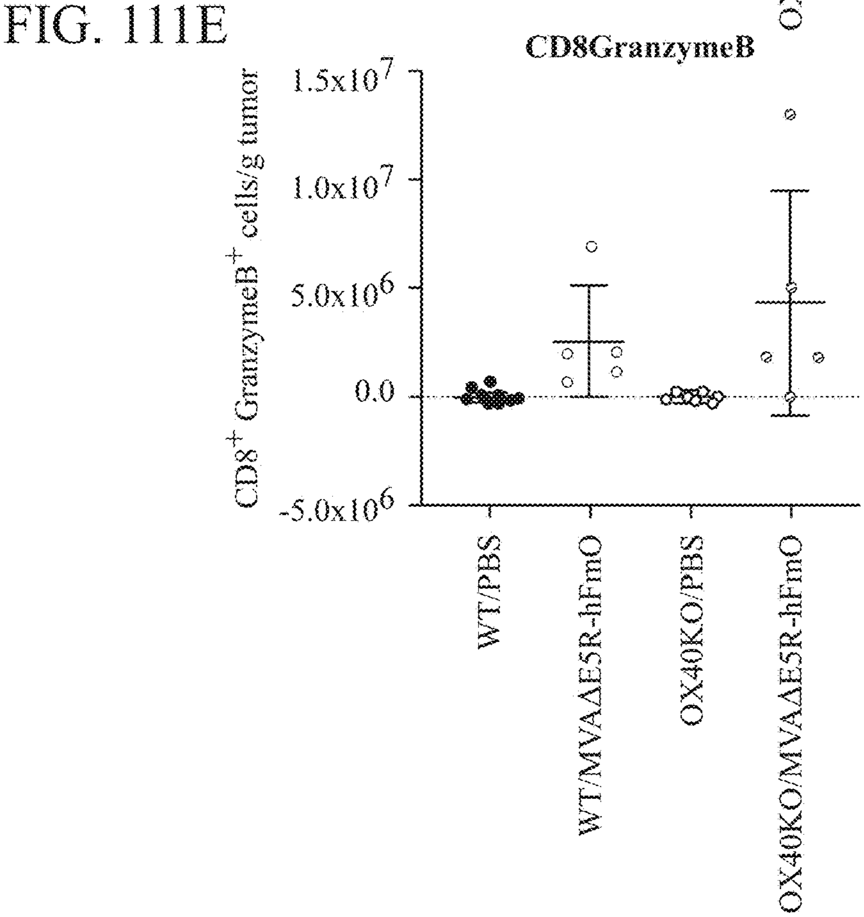
FIG. 111E shows the graph of absolute numbers of Granzyme $B^+$ $CD8^+$ T cells per gram of tumor. Data are means ±SEM (n=4-10).
Figure 112A:
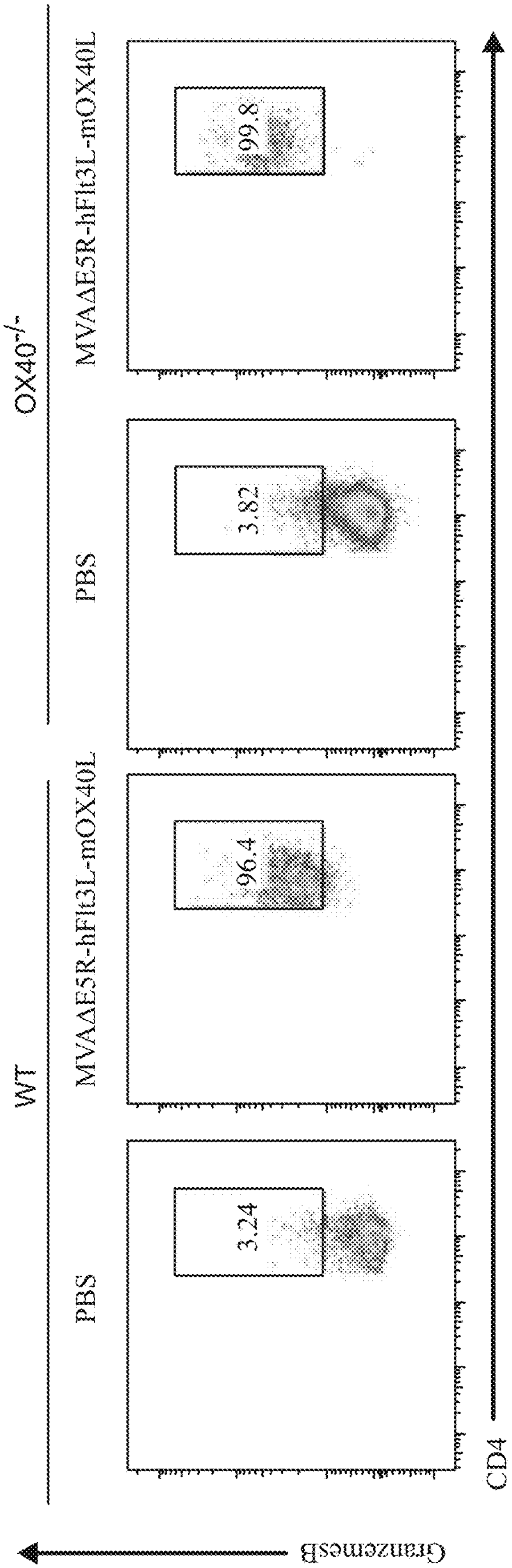
FIG. 112A shows the representative dot plots of Granzyme $B^+$ $CD4^+$ T cells in the injected tumors from WT and $OX40^{-/-}$ mice after treatment with either MVAΔE5R-hFl3L-mOX40L or PBS.
Figure 112B:
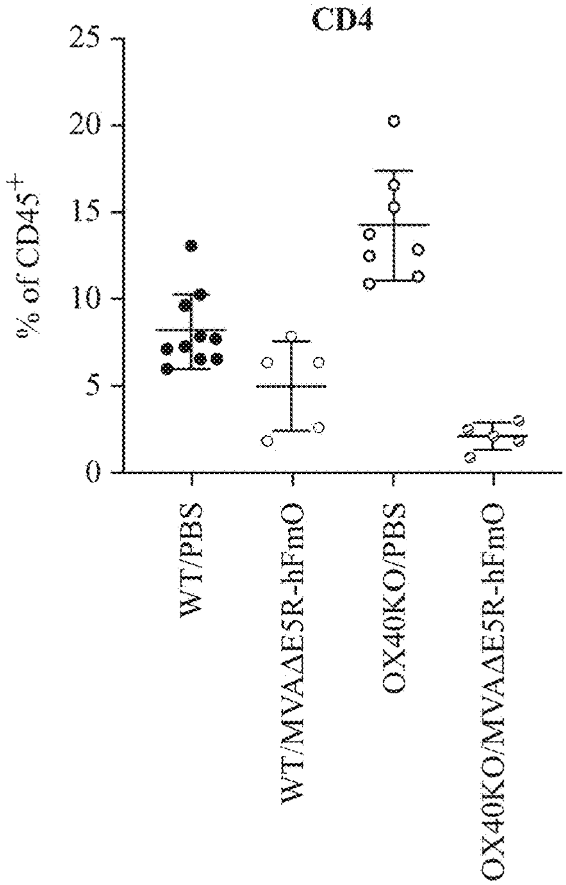
FIG. 112B shows the graph of percentages of $CD4^+$ T cells out of $CD3^+$ cells. Data are means ±SEM (n=4-10).
Figure 112C:
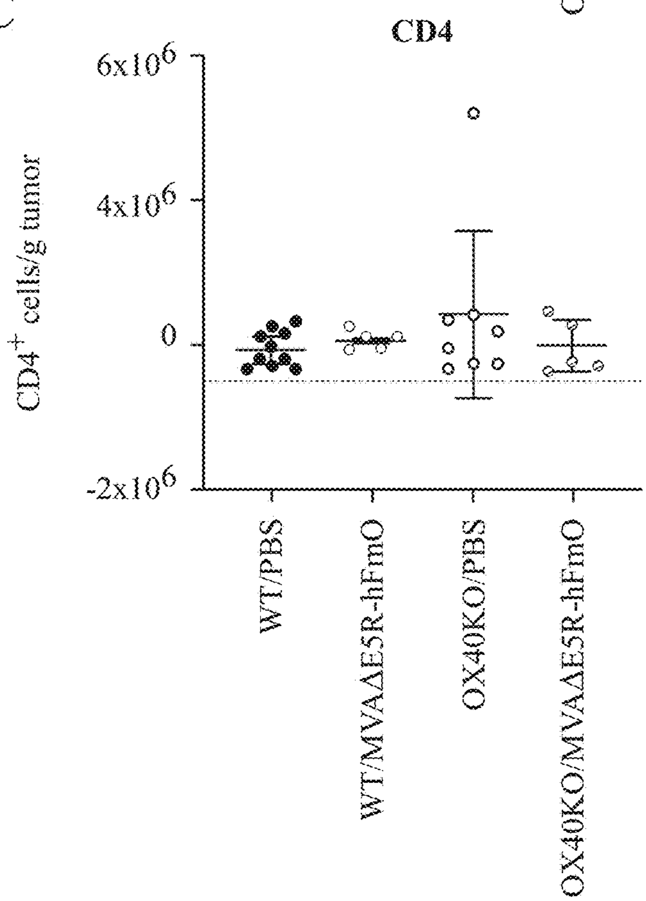
FIG. 112C shows the graph of absolute numbers of $CD4^+$ T cells per gram of tumor. Data are means ±SEM (n=4-10).
Figure 112D:
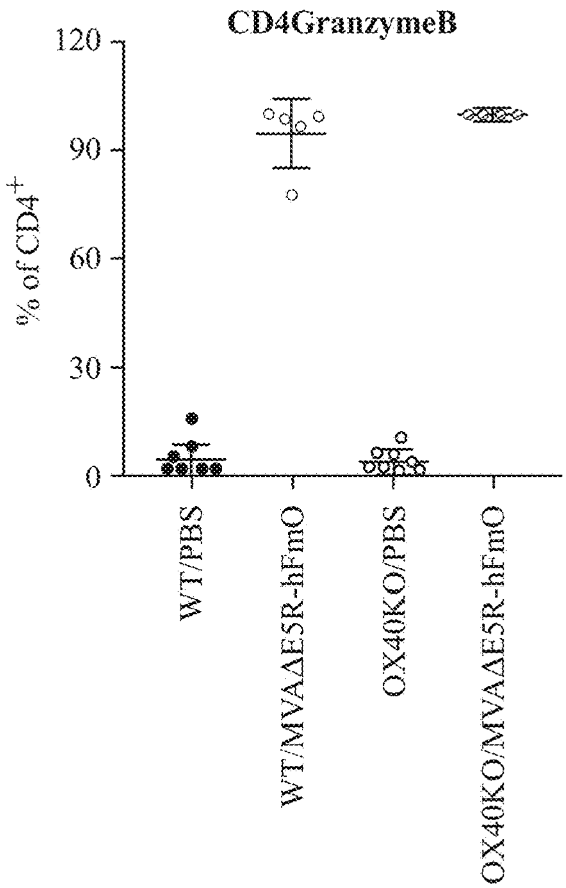
FIG. 112D shows the graph of percentages of Granzyme $B^+$ $CD4^+$ T cells out of $CD4^+$ cells. Data are means ±SEM (n=4-10).
Figure 112E:
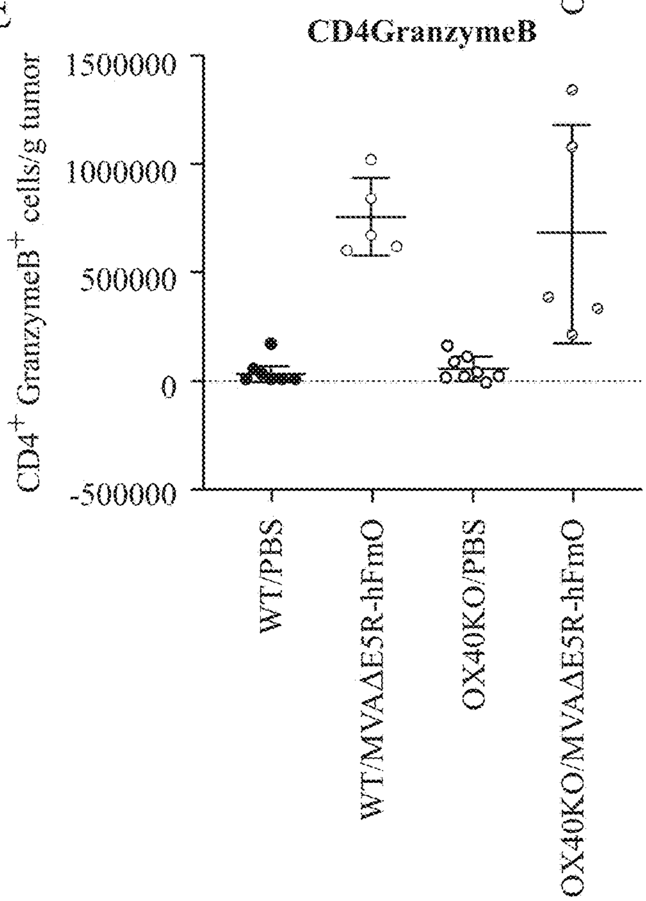
FIG. 112E shows the graph of absolute numbers of Granzyme $B^+CD4^+$ T cells per gram of tumor. Data are means ±SEM (n=4-10).

To compare the immune responses induced by IT injection of MVAΔE5R-hFlt3L-mOX40L in WT and $OX40^{-/-}$ mice, a bilateral B16-F10 tumor implantation model was used. Briefly, B16-F10 melanoma cells were implanted intradermally into the shaved skin on the right ($5\times10^5$ cells) and left ($2.5\times10^5$ cells) flanks of wild-type C57BL/6J or $OX40^{-/-}$ mice. Ten days post implantation, the larger tumors on the right flank were injected twice per week with $4\times10^7$ pfu of MVAΔE5R or MVAΔE5R-hFlt3L-mOX40L or PBS. Two days post second injection, tumors were harvested and cells were processed for surface labeling with anti-CD3, CD45, CD4, CD8 and OX40 antibodies, and also for intracellular Granzyme B, Ki67 and FoxP3 staining. The live immune cell infiltrates in the tumors were analyzed by FACS (FIG. 110). In both wild-type and $OX40^{-/-}$ mice, IT injection of MVAΔE5R-hFlt3L-mOX40L resulted in higher percentage and numbers of total $CD8^+$ T cells and $CD8^+$ Granzyme $B^+$ T cells in the injected tumors compared with PBS group (FIGS. 111A-111E). IT injection of MVAΔE5R-hFl3L-mOX40L also resulted in higher percentage and numbers of total $CD4^+$ T cells and CD4 Granzyme $B^+$ T cells in the injected tumors from both wild-type and $OX40^{-/-}$ mice (FIGS. 112A-112E). The Granzyme B expressions in $CD8^+$ and $CD4^+$ T cells in MVAΔE5R-hFl3L-mOX40L-injected tumors were higher in $OX40^{-/-}$ mice compared with WT mice (FIGS. 111A-112E). These results suggest that OX40 expression might be related in immune suppression in the tumors. Since tumor-infiltrating Tregs express high levels of OX40, without being bound by theory, it is postulated that OX40 expression on regulatory T cells might be important for their immune-suppressive function.

Example 100: Intratumoral (IT) injection of MVAΔE5R-hFlt3L-mOX40L reduces regulatory T cells in the injected tumors from wild-type mice but not $OX40^{-/-}$ mice in B16-F10 bilateral tumor implantation model.

Figure 113A:
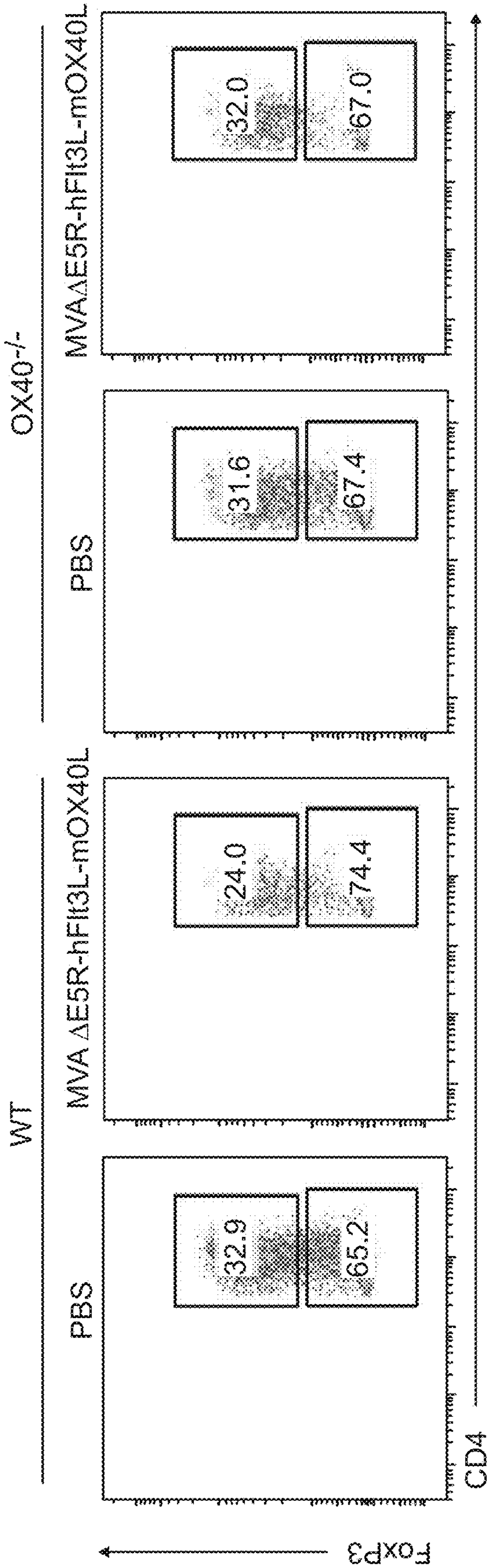
FIG. 113A shows the IT injection of MVAΔE5R-hFl3L-mOX40L fails to reduce $FoxP3^+CD4^+$ T cells in the injected tumors from $OX40^{-/-}$ mice. Representative dot plots of $FoxP3^+CD4^+$ T cells in the injected tumors from WT and $OX40^{-/-}$ mice after treatment with either MVAΔE5R-hFl3L-mOX40L or PBS.
Figure 113B:
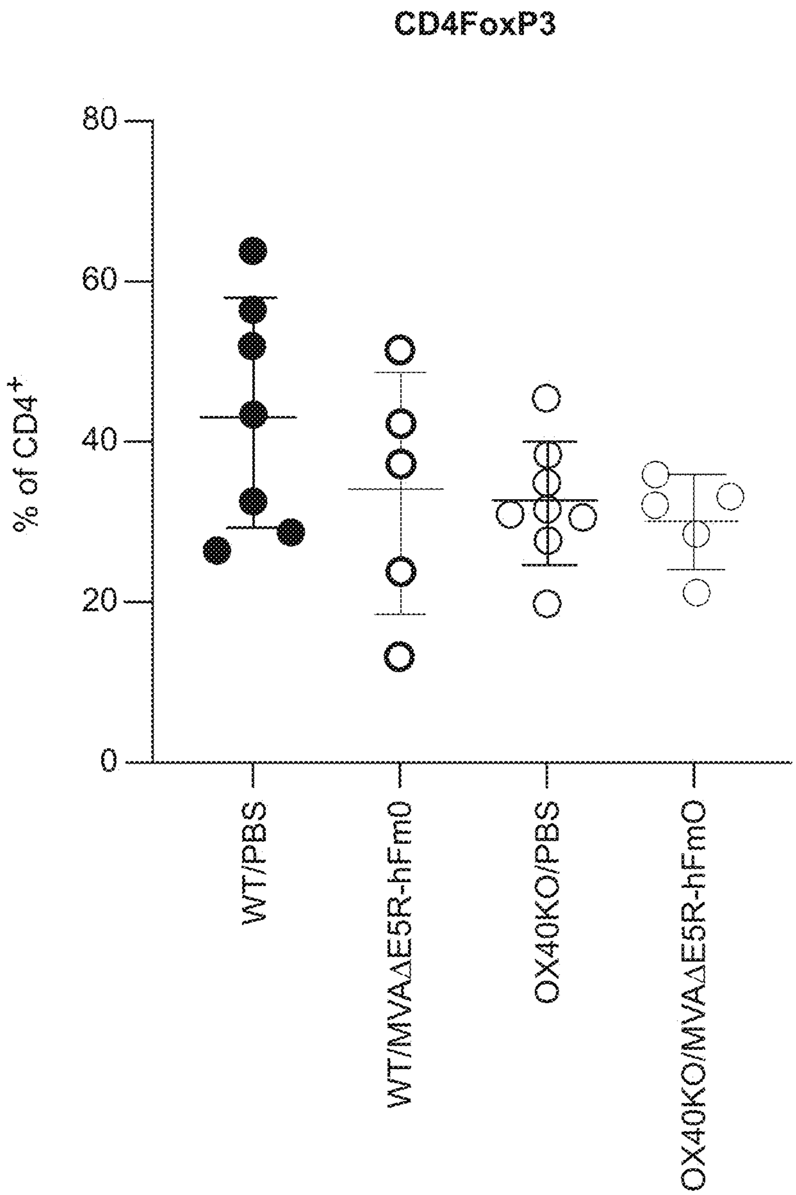
FIG. 113B shows the graph of percentages of $FoxP3^+CD4^+$ T cells out of $CD4^+$ cells Data are means ±SEM (n=4-10).
Figure 114A:
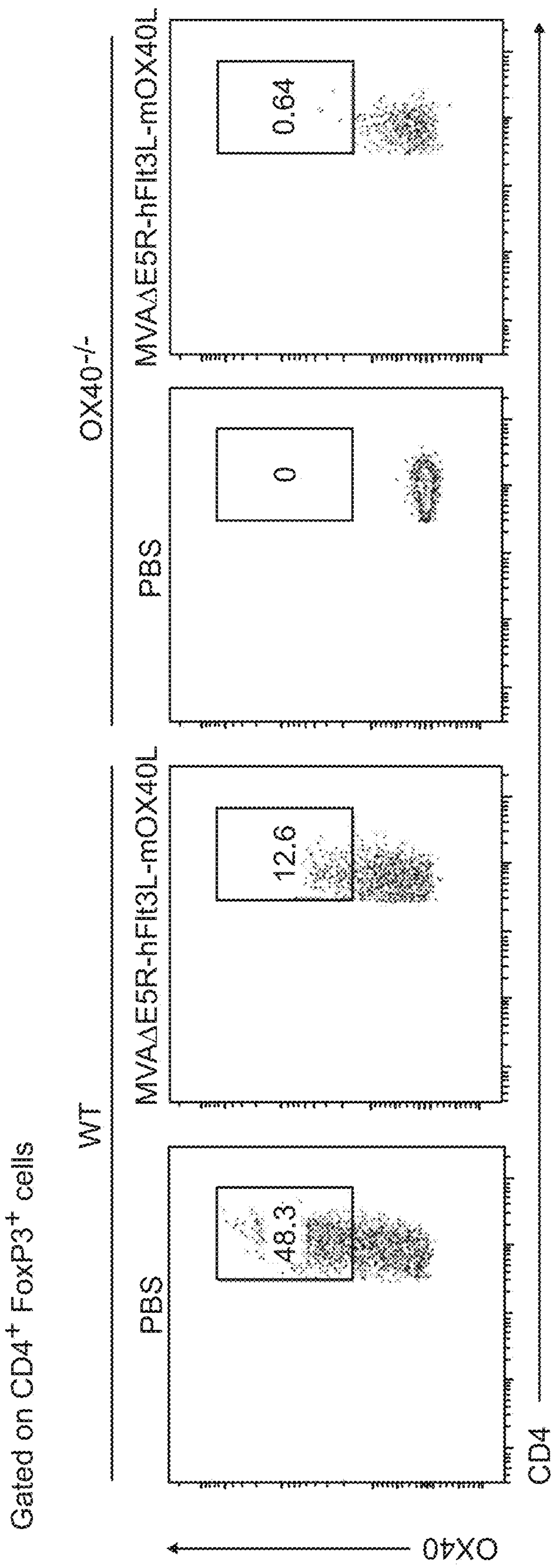
Figure 114C:
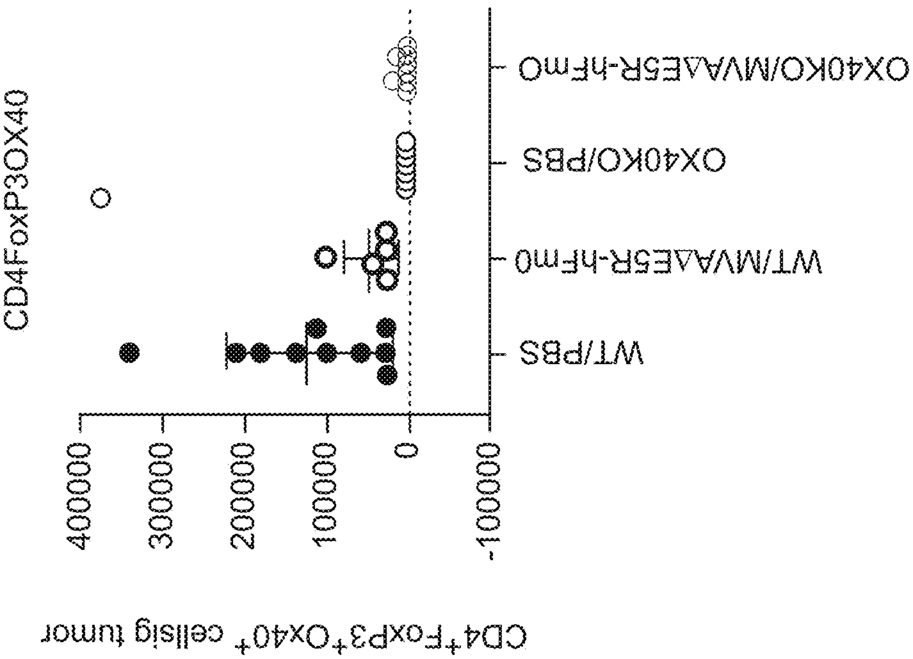
FIG. 114C shows the graph of absolute numbers of $OX40^+FoxP3^+$ $CD4^+$ T cells per gram of tumor. Data are means ±SEM (n=4-10).
Figure 114B:
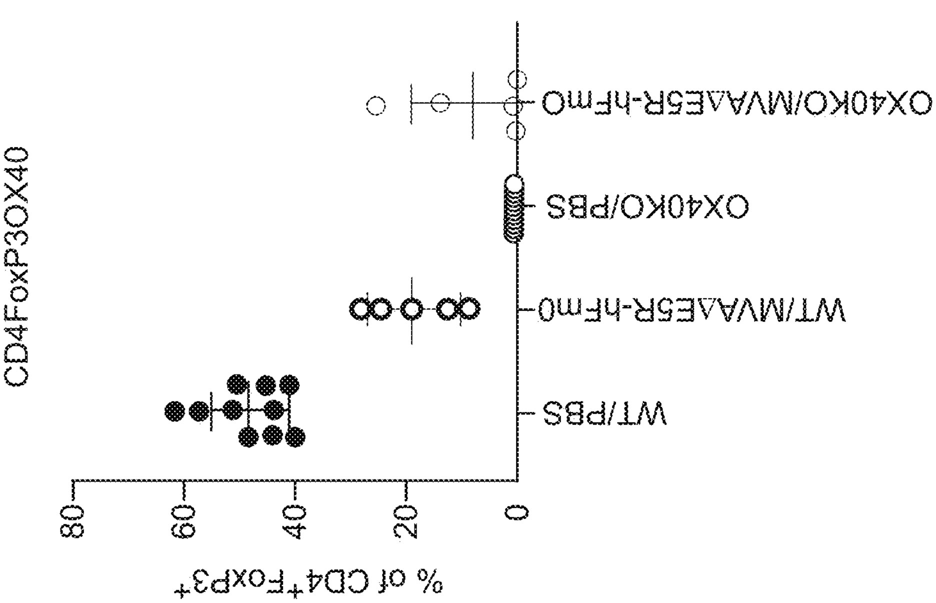
FIG. 114B shows the graph of percentages of $OX40^+FoxP3^+CD4^+$ T cells out of $CD4^+$ cells. Data are means ±SEM (n=4-10).

To test whether the reduction of regulatory T cells by IT injection of MVAΔE5R-hFl3L-mOX40L is due to OX40L-OX40 interaction, the percentages of $CD4^+FoxP3^+$ T cells out of $CD4^+$ T cells were compared in the injected tumors from wild-type mice treated with PBS or MVAΔE5R-hFl3L-mOX40L vs. $OX40^{-/-}$ mice treated with PBS or MVAΔE5R-hFl3L-mOX40L. In WT mice, the percentages of $CD4^+FoxP3^+$ T cells out of $CD4^+$ T cells were reduced in MVAΔE5R-hFl3L-mOX40L-treated tumors compared with PBS-treated tumors. By contrast, in $OX40^{-/-}$ mice, the percentages of $CD4^+FoxP3^+$ T cells out of $CD4^+$ T cells were similar in PBS and MVAΔE5R-hFl3L-mOX40L group (FIGs.113A-113B). In WT mice, the percentages of $OX40^+FoxP3^+CD4^+$ cells were reduced from 48% in the PBS-treated tumors to 19% in MVAΔE5R-hFl3L-mOX40L-treated tumors (FIGS. 114A-114C). The absolute numbers of $OX40^+FoxP3^+CD4^+$ cells per gram of tumor were reduced from—in the PBS-treated tumors to —in MVAΔE5R-hFl3L-mOX40L-treated tumors (FIG. 114B). As expected, OX40 expression on $FoxP3^+CD4^+$ cells were absent (FIG. 114C). These results indicate that MVAΔE5R-hFl3L- mOX40L-induced reduction of Tregs in injected tumors is likely dependent on the expression of OX40 on Tregs.

Figure 115A:
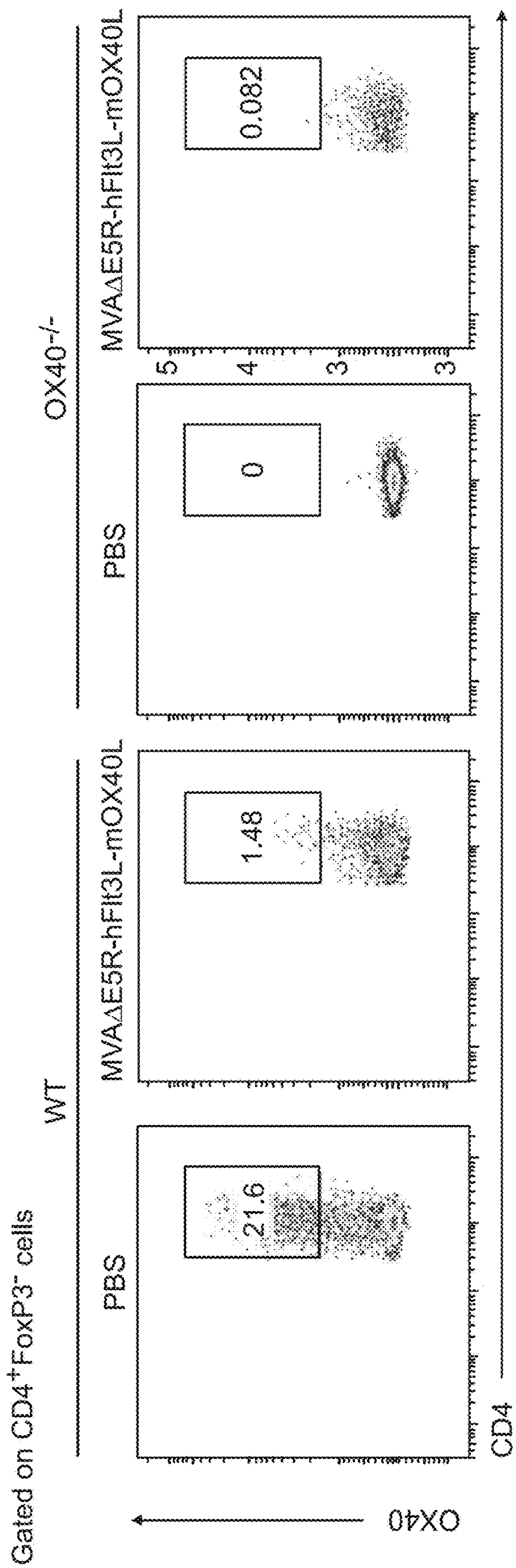
FIG. 115A shows the representative dot plots of $OX40^+$ $FoxP3^+CD4^+$ T cells in the injected tumors from WT and $OX40^{-/-}$ mice after treatment with either MVAΔE5R-hFl3L-mOX40L or PBS.
Figure 115C:
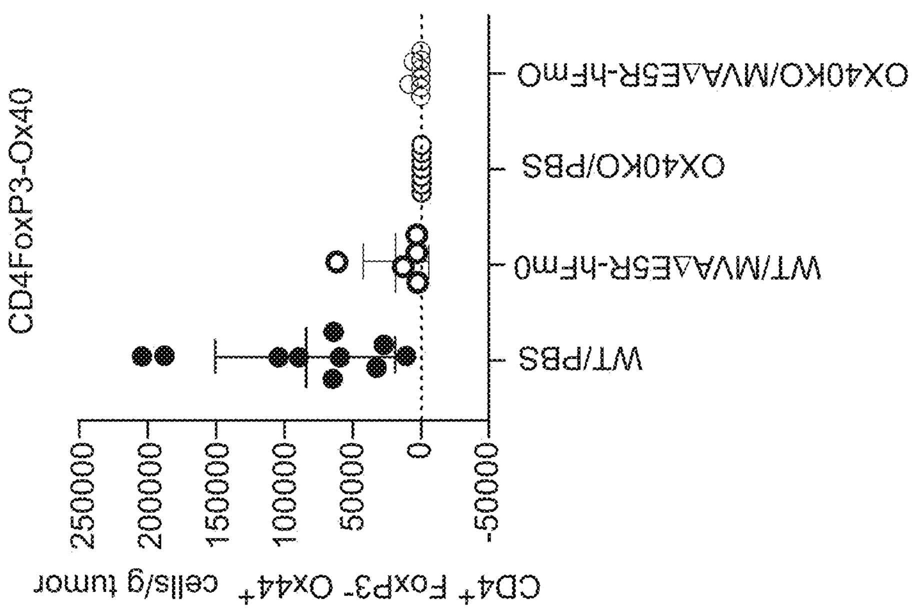
Figure 115B:
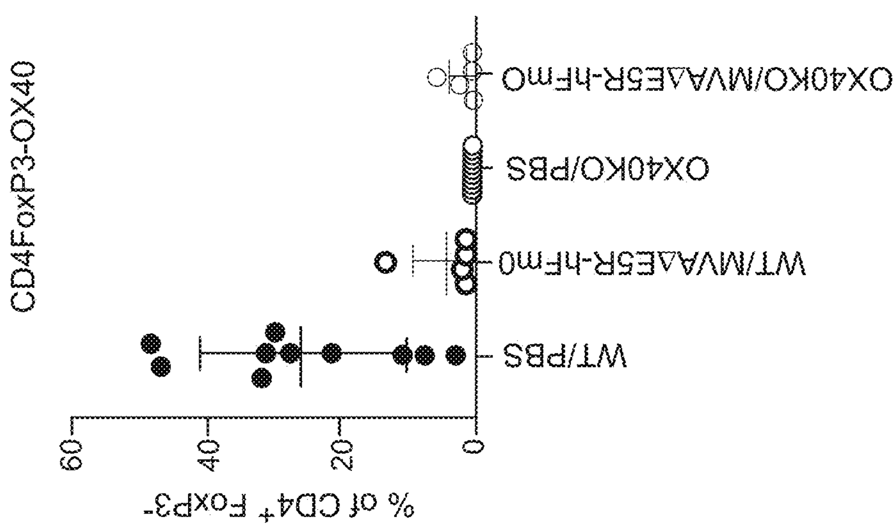
FIG. 115B shows the graph of percentages of $OX40^+FoxP3^+CD4^+$ T cells out of $CD4^+$ cells. Data are means ±SEM (n=4-10).
Figure 116A:
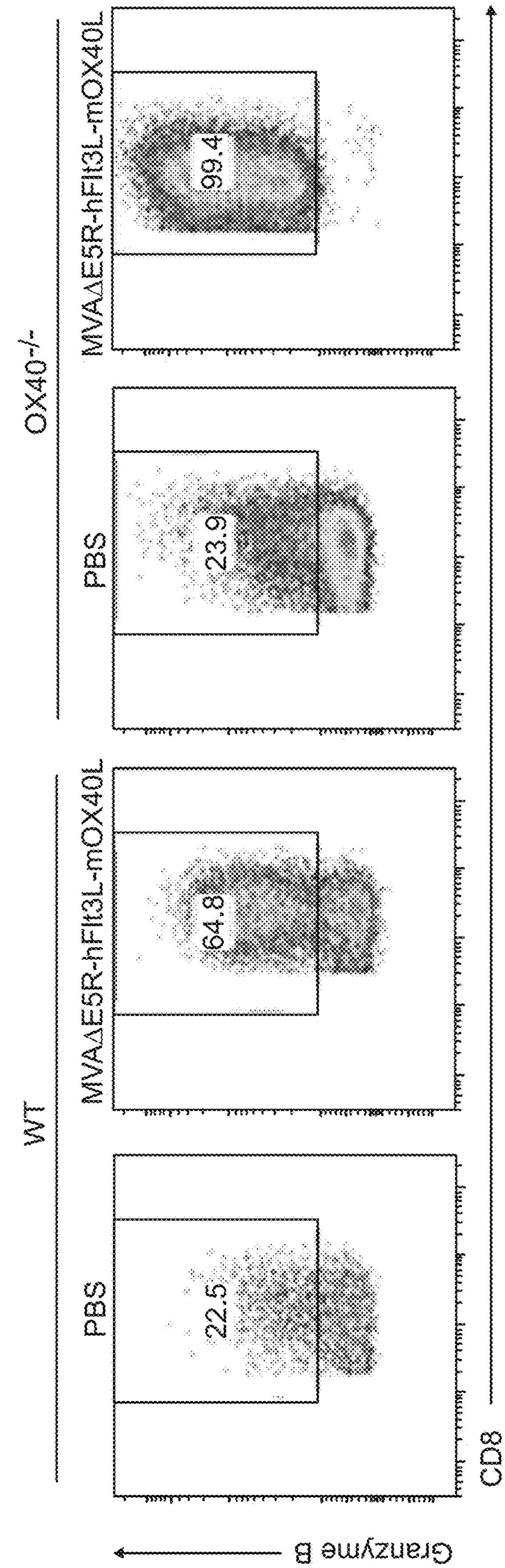
Figure 116C:
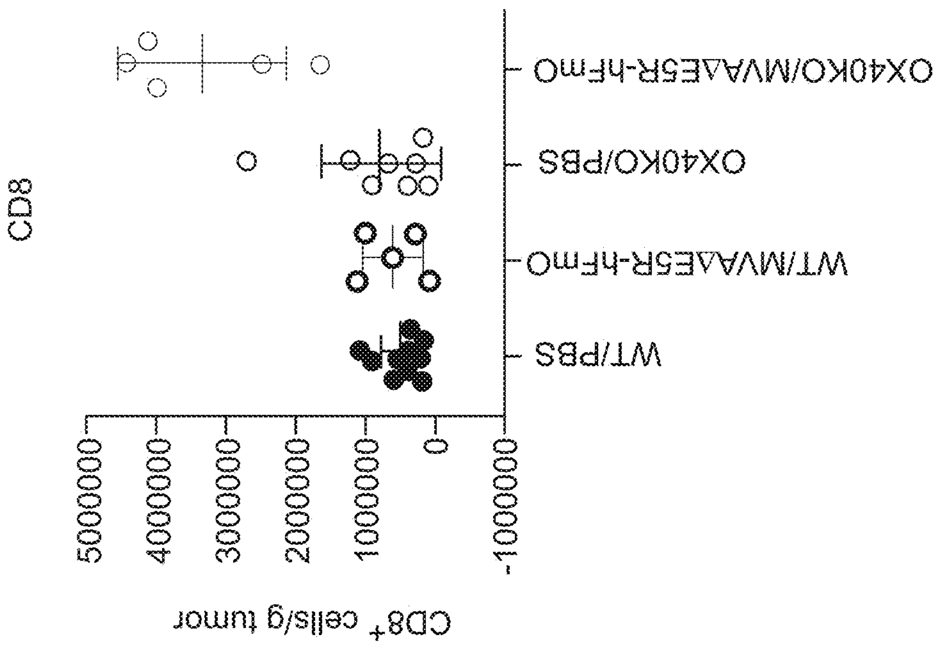
FIG. 116C shows the graph of absolute numbers of $CD8^+$ T cells per gram of tumor. Data are means ±SEM (n=5-10).
Figure 116B:
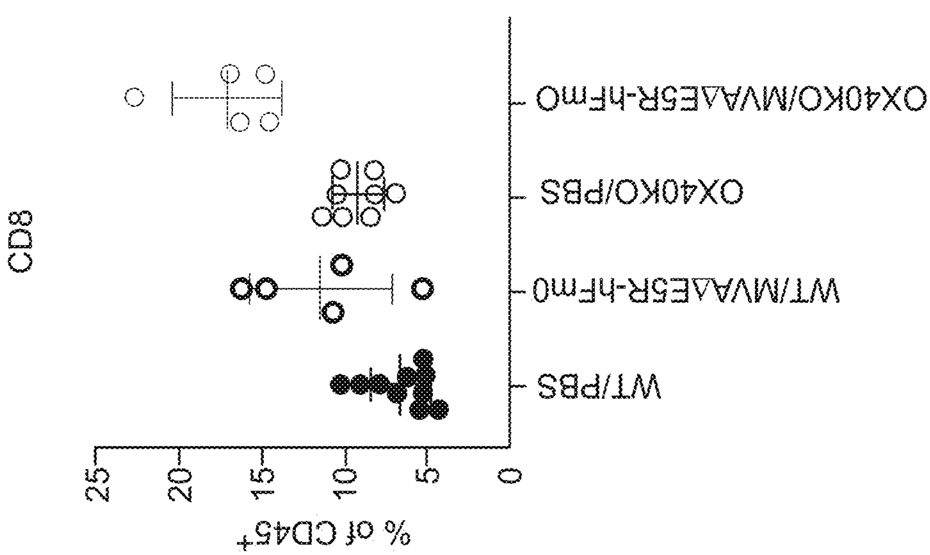
FIG. 116B shows the graph of percentages of $CD8^+$ T cells out of $CD45^+$ cells. Data are means ±SEM (n=5-10).
Figure 116E:
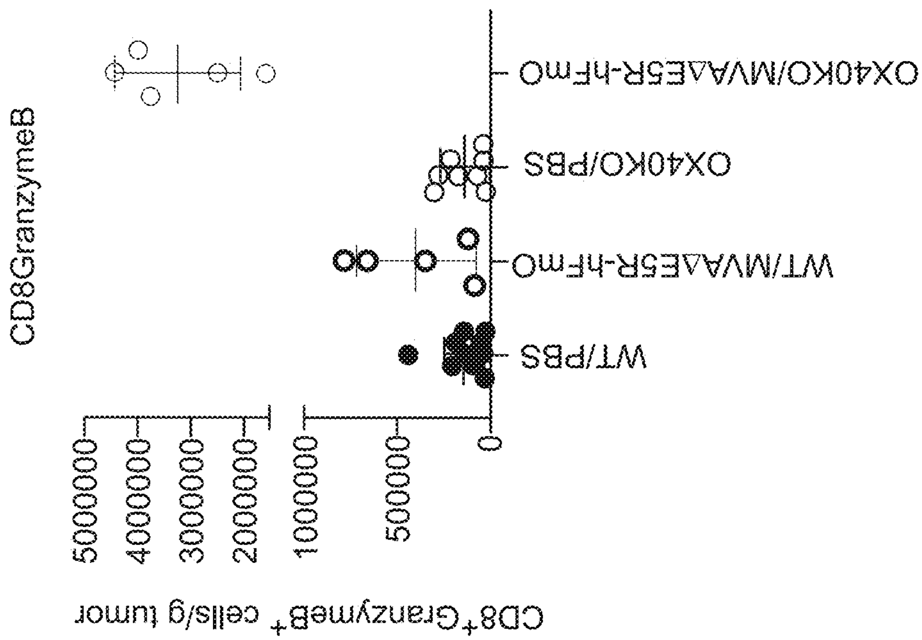
FIG. 116E shows the graph of absolute numbers of Granzyme $B^+$ $CD8^+$ T cells per gram of tumor. Data are means ±SEM (n=5-10).
Figure 116D:
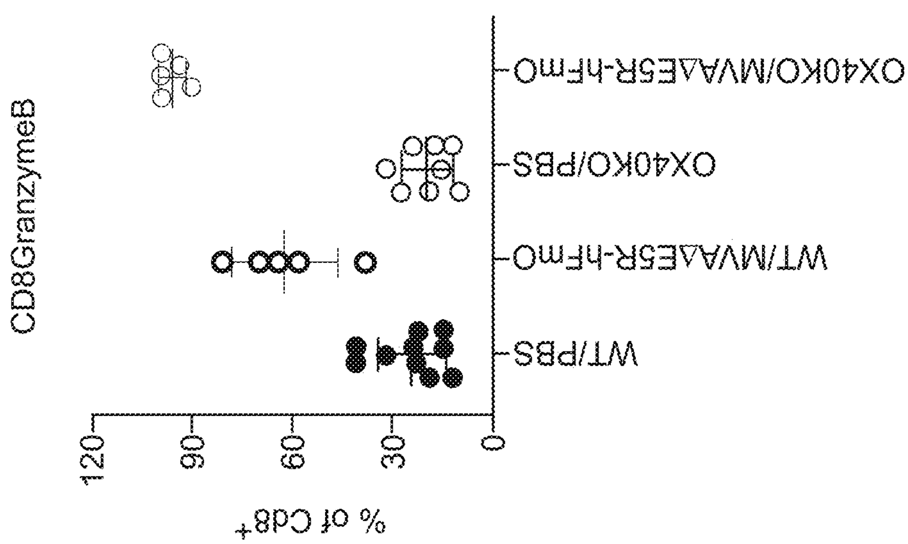
FIG. 116D shows the graph of percentages of Granzyme $B^+$ $CD8^+$ T cells out of $CD8^+$ cells. Data are means ±SEM (n=5-10).
Figure 118A:
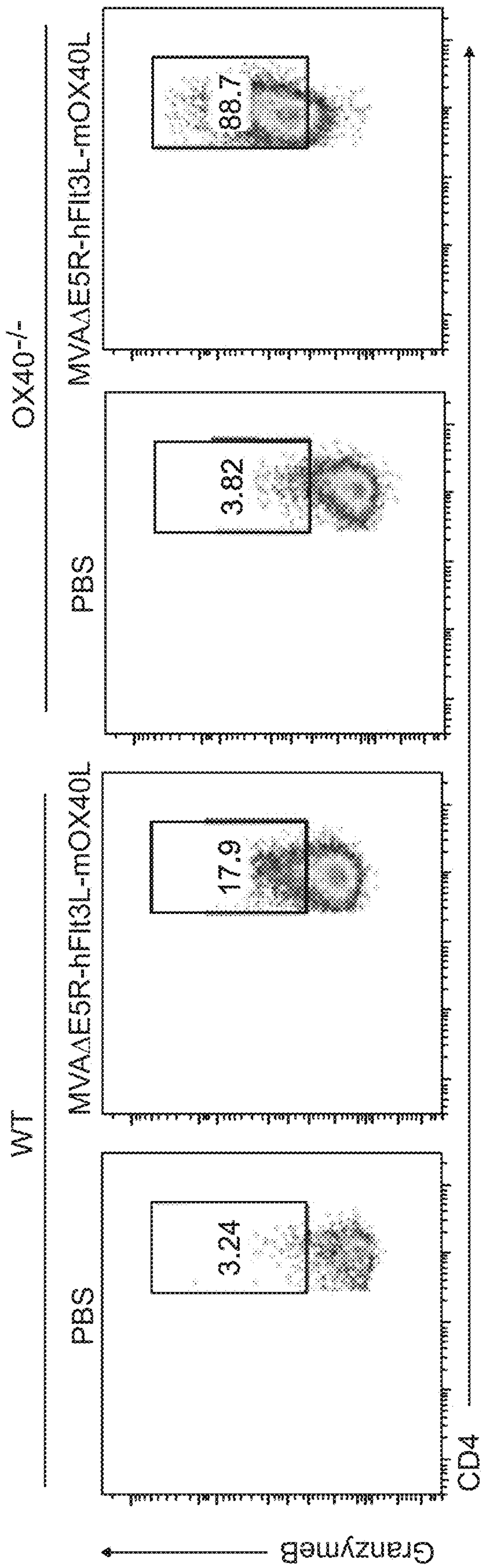
FIG. 118A shows the representative dot plots of Granzyme $B^+CD4^+$ T cells in none-injected tumors from WT and $OX40^{-/-}$ mice after treatment with either MVAΔE5R-hFl3L-mOX40L or PBS.
Figure 118C:
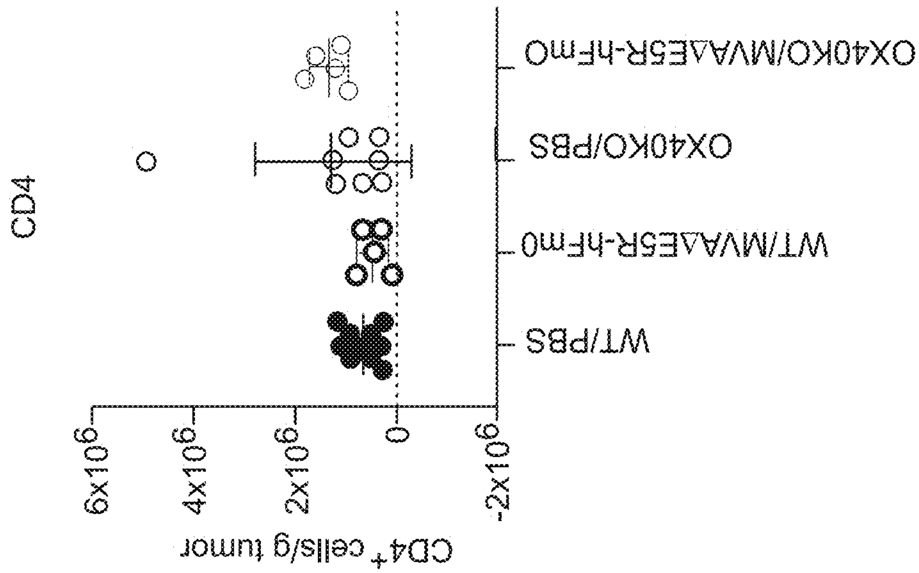
FIG. 118C shows the graph of absolute numbers of $CD4^+$ T cells per gram of tumor. Data are means ±SEM (n=5-10).
Figure 118B:
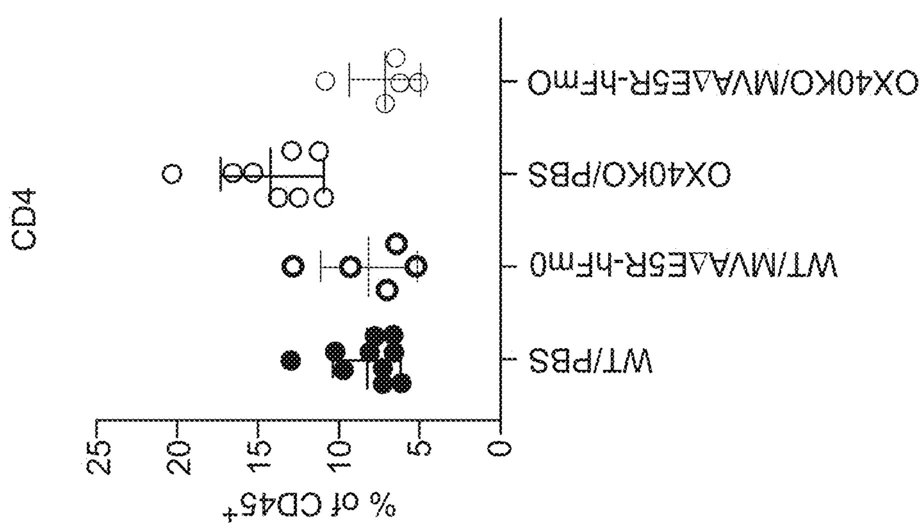
FIG. 118B shows the graph of percentages of $CD4^+$ T cells out of $CD45^+$ cells. Data are means ±SEM (n=5-10).
Figure 118D:
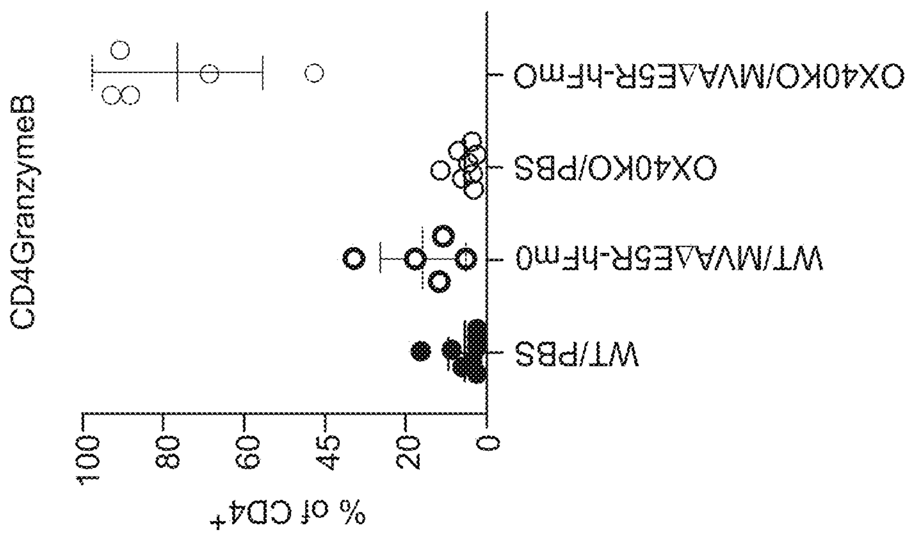
FIG. 118D shows the graph of percentages of Granzyme $B^+$ $CD4^+$ T cells out of $CD4^+$ cells. Data are means ±SEM (n=5-10).
Figure 118E:
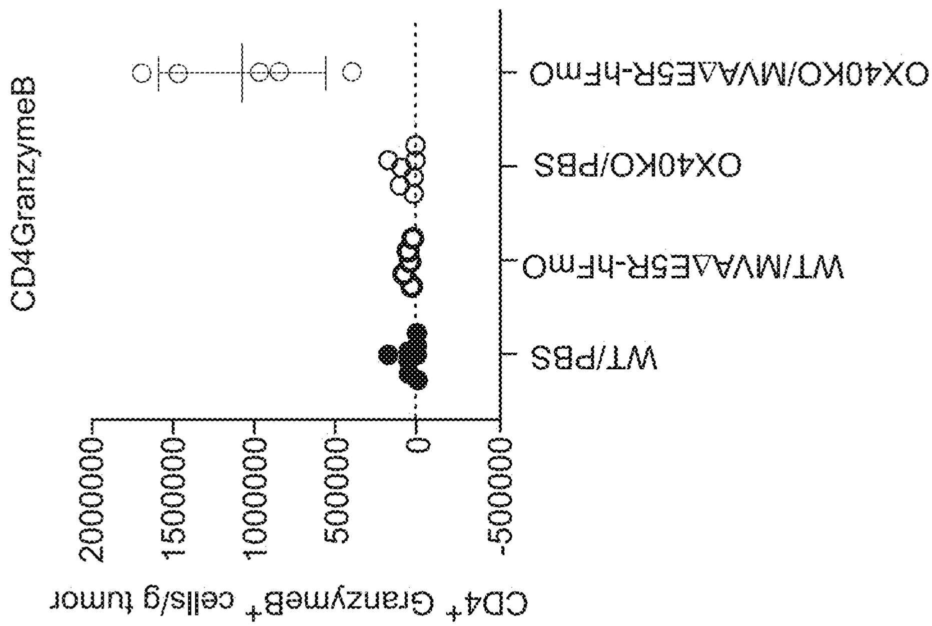
FIG. 118E shows the graph of absolute numbers of Granzyme $B^+$ $CD4^+$ T cells per gram of tumor. Data are means ±SEM (n=5-10).
Figure 119A:
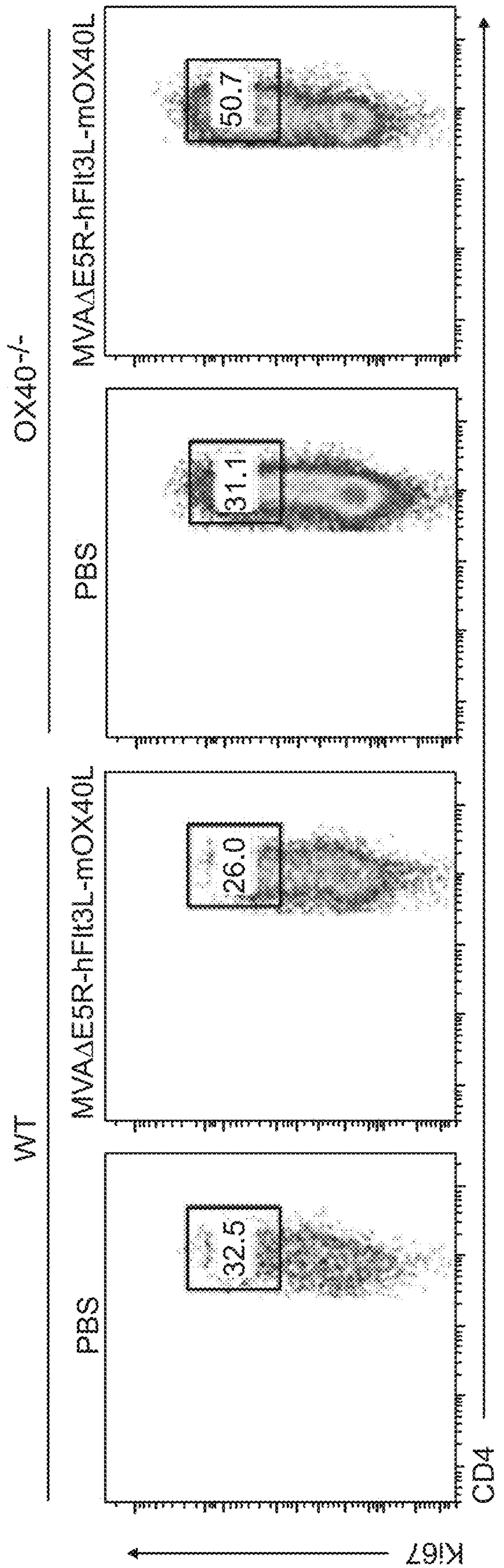
FIG. 119A shows the representative dot plots of $Ki67^+$ $CD4^+$ T cells in non-injected tumors from WT and $OX40^{-/-}$ mice after treatment with either MVAΔE5R-hFl3L-mOX40L or PBS.
Figure 119B:
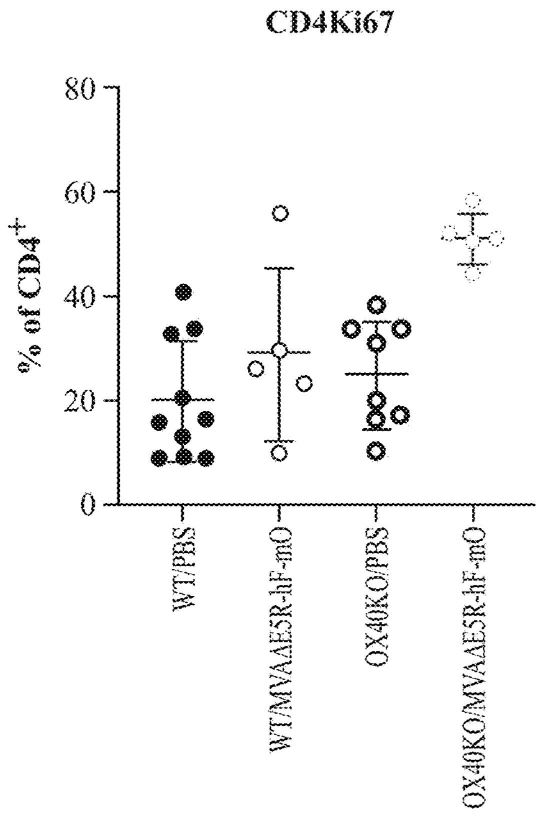
FIG. 119B shows the graph of percentages of $Ki67^+CD4^+$ T cells out of $CD4^+$ cells. Data are means ±SEM (n=5-10).
Figure 119C:
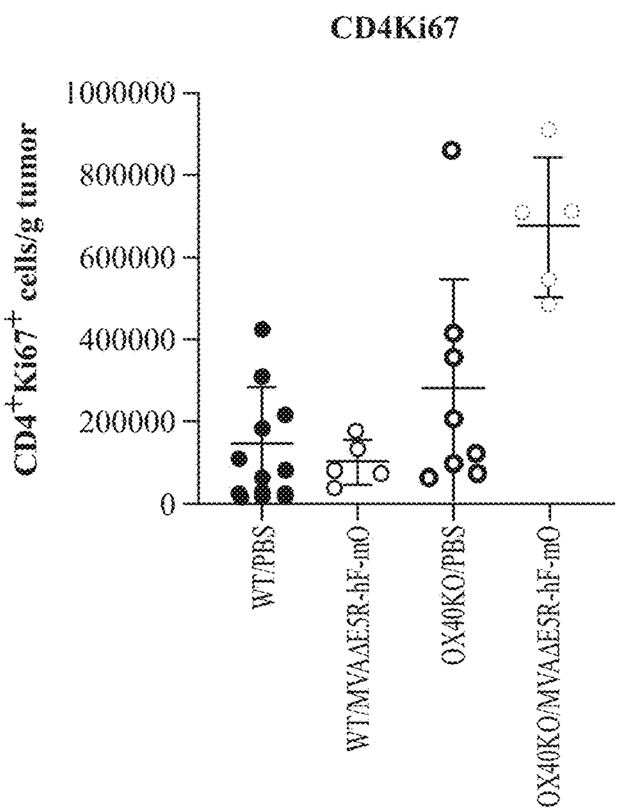

The expression of OX40 on FoxP3$^-$CD4$^+$ was also reduced in MVAΔE5R-hFl3L-mOX40L-treated tumors compared with PBS-treated tumors in WT mice (FIGS. 115A-115C). Without wishing to be bound by theory, it is possible that OX40L/OX40 interaction might lead to failure to detect OX40 expression on these cells.

Example 101: Intratumoral (IT) injection of MVAΔE5R-hFlt3L-mOX40L results in stronger activation and proliferation of CD8$^+$ and CD4$^+$ T cells in the non-injected tumors from OX40$^{-/-}$ mice compared with WT mice.

To test whether IT MVAΔE5R-hFl3L-mOX40L results in immune responses in the non-injected tumors, the non-injected tumors were harvested 2 days after second injection with either MVAΔE5R-hFl3L-mOX40L or PBS. FACS analysis was performed to evaluate Granzyme B (an activation marker) and Ki67 (a proliferation marker) expression on CD8$^+$ and CD4$^+$ T cells. IT MVAΔE5R-hFl3L-mOX40L results in the increase of percentages of CD8$^+$ cells out of CD45$^+$ cells as well in the increase of percentages of Granzyme B$^+$CD8$^+$ cells out of CD8$^+$ cells compared with those treated with PBS (FIGS. 116A-116E). In addition, IT MVAΔE5R-hFl3L-mOX40L results in the increase of Ki67$^+$ CD8$^+$ cells out of CD8$^+$ T cells compared with those treated with PBS (FIGS. 117A-117C). In the OX40$^{-/-}$ mice, IT MVAΔE5R-hFl3L-mOX40L elicited stronger activation and proliferation responses on CD8$^+$ T cells in the non-injected tumors compared with those in WT mice (FIGS. 116A-117C).

Similar observations were made when the percentages of Granzyme B$^+$CD4$^+$ and Ki67$^+$CD4$^+$ T cells out of CD4$^+$ T cells in non-injected tumors from mice treated with IT MVAΔE5R-hFl3L-mOX40L compared with those treated with PBS. IT MVAΔE5R-hFl3L-mOX40L also elicited stronger activation and proliferation responses on CD4$^+$ T cells in the non-injected tumors of OX40$^{-/-}$ mice compared with those in WT mice (FIGS. 118A-119C). These results suggest that OX40 negatively regulate immune responses induced by IT MVAΔE5R-hFl3L-mOX40L at both injected and non-injected tumors. It is possible that OX40 is important for OX40$^+$FoxP3$^+$CD4$^+$ T cells for their immune suppressive functions, which dampens both CD4$^+$ and CD8$^+$ effector T cell functions. These results suggest that combination of IT immunogenic and IFN-inducing MVA, such as MVAΔE5R, with systemic delivery of OX40 blocking agent, such as an anti-OX40L antibody, might elicit strong antitumor effects at both injected and non-injected tumors, and demonstrate that these viral constructs are useful in methods for treating solid tumors.

Example 102: Intratumoral (IT) injection of MVAΔE5R-hFlt3L-mOX40L leads to activation of local CD8$^+$ T cells in the injected tumors in B16-F10 bilateral tumor implantation model.

To assess whether blocking T cells trafficking from lymphoid organs to peripheral blood would affect antitumor effects elicited by IT MVAΔE5R-hFlt3L-mOX40L, a bilateral B16-F10 tumor implantation model was used and FTY720, an immunomodulatory drug that inhibits lymphocytes egress from lymphoid tissues (Figure. XX slide27). Briefly, B16-F10 melanoma cells were implanted intradermally into the shaved skin on the right ($5\times10^5$ cells) and left ($2.5\times10^5$ cells) flanks of C57BL/6J mice. Seven days post implantation, each mouse was injected intraperitoneally with 25 μg FTY720 or DMSO as control every other day. Nine days post implantation, the larger tumors on the right flank were injected twice per week with $4\times10^7$ pfu of MVAΔE5R-hFlt3L-mOX40L or PBS, three days apart. Tumor growth was monitored. Two days post second injection, tumors were harvested and weighed. Cells were processed for surface labeling with anti-CD3, CD45, CD4, CD8 and OX40 antibodies, and also for intracellular Granzyme B and Ki67 staining. The live immune cell infiltrates in the tumors were analyzed by FACS (FIG. 120).

In PBS treated groups, both injected and non-injected tumors grew more aggressively in the presence of FTY720, compared with the DMSO control group (FIG. 121). By contrast, IT MVAΔE5R-hFl3L-mOX40L inhibited the growth of both injected and non-injected tumors from both FTY720 or DMSO treated mice (FIG. 121).

The percentages of CD8$^+$ T cells out of CD45$^+$ cells in the injected tumors were increased with IT MVAΔE5R-hFl3L-mOX40L in DMSO control group. After FTY720 treatment, the percentages of CD8$^+$ T cells out of CD45$^+$ cells were slightly lower than DMSO/PBS group and IT MVAΔE5R-hFl3L-mOX40L treatment did not increase the percentages of CD8$^+$ T cells out of CD45$^+$ cells (FIG. 122A-122D) XXB). By contrast, IT MVAΔE5R-hFl3L-mOX40L resulted in significantly increased percentages of Granzyme B$^+$ CD8$^+$ T cells in both DMSO and FTY720 groups (FIG. 122A and 122C). IT MVAΔE5R-hFl3L-mOX40L also led to increased percentage of Ki67$^+$CD8$^+$ T cells in both DMSO and FTY720 groups (FIG. 122D).

In addition, in the presence of FTY720, IT MVAΔE5R-hFl3L-mOX40L resulted in higher percentages of activated Granzyme B$^+$CD8$^+$ and Ki67$^+$CD8$^+$ T cells in the TDLNs of injected tumors compared with DMSO (FIGS. 123A-124B), which indicated that the activated CD8$^+$ T cells induced by IT MVAΔE5R-hFl3L-mOX40L were trapped in LNs in the presence of FTY720. These results demonstrate that IT MVAΔE5R-hFl3L-mOX40L activates local CD8$^+$ T cells and is able to inhibit tumor growth even without recruiting T cells from lymphoid organs and is useful in methods for treating solid tumors. Accordingly, these results demonstrate that the recombinant poxviruses of the present technology are useful in methods for treating solid tumors.

Example 103: Intratumoral (IT) injection of MVAΔE5R-hFlt3L-mOX40L delays tumor growth in AT3 triple negative breast cancer model.

To assess the antitumor effects generated by IT injection of MVAΔE5R-hFl3L-mOX40L in brast tumors, a bilateral AT3 murine breast tumor implantation model was used (FIG. 125). Briefly, $1\times10^5$ AT3 cells were implanted to the $4^{th}$ fat pad of a C57BL/6J mouse. 14 days post tumor implantation, $6\times10^7$ pfu of MVAΔE5R-hFl3L-mOX40L, or Heat-iMVA, or PBS were intratumorally injected twice, three days apart. The tumors were measured before each injection. Two days post second injection, the injected tumors were measured and harvested for weight measurement and FACS analysis. IT injection of MVAΔE5R-hFl3L-mOX40L resulted in delayed tumor growth compared with Heat-iMVA or PBS (FIG. 126A). The tumors with IT MVAΔE5R-hFl3L-mOX40L were smaller compared with Heat-iMVA or PBS after two injections (FIG. 126B). These results demonstrate that IT MVAΔE5R-hFl3L-mOX40L resulted in stronger antitumor effect compared with Heat-iMVA in AT3 breast tumor implantation model. Accordingly, these results demonstrate that the recombinant poxviruses of the present technology are useful in treating solid tumors.

Example 104: Intratumoral (IT) injection of MVAΔE5R-hFlt3L-mOX40L leads to activation of $CD8^+$ T cells and reduction of regulatory T cells in the injected tumors in AT3 triple negative breast cancer model.

To assess the immune responses induced by IT injection of MVAΔE5R-hFl3L-mOX40L in breast tumors, a bilateral AT3 murine breast tumor implantation model was used as described in Example 103 (FIG. 125). Two days post second injection, the injected tumors were harvested and cells were processed for surface labeling with anti-CD3, CD45, CD4 and CD8 antibodies, and also for intracellular Granzyme B and FoxP3 staining. IT injection of MVAΔE5R-hFl3L-mOX40L resulted in higher percentages and absolute numbers of $CD8^+$ T cells compared with Heat-iMVA or PBS (FIG. 127B). IT injection of MVAΔE5R-hFl3L-mOX40L also induces higher percentages of $GranzymeB^+CD8^+$ T cells compared with Heat-iMVA (FIGS. 127A and 127C). However, neither IT injection of MVAΔE5R-hFl3L-mOX40L or Heat-iMVA induced higher percentages of $GranzymeB^+CD4^+$ T cells (FIGS. 128A-128E). The percentage of $CD4^+FoxP3^+$ T cells was reduced from 31% to about 11% with IT MVAΔE5R-hFl3L-mOX40L or Heat-iMVA (FIGS. 129A-129C). These results demonstrate that IT MVAΔE5R-hFl3L-mOX40L leads to activation of $CD8^+$ T cells and reduction of regulatory T cells in AT3 breast tumor implantation model, and is useful in methods for treating solid tumors.

Example 105: The combination of intratumoral injection of MVAΔE5R-hFlt3L-mOX40L and systemic delivery of anti-PD-L1 antibody cures bilateral B16-F10 melanoma.

To test whether the combination with IT delivery of MVAΔE5R-hFl3L-mOX40L and systemic delivery of anti-PD-L1 had superior anti-tumor efficacy compared with IT virus alone, a bilateral murine B16-F10 tumor implantation model was used. Briefly, B16-F10 melanoma cells were implanted intradermally to the left and right flanks of C57B/6 mice ($5\times10^5$ to the right flank and $1\times10^5$ to the left flank). Seven days after tumor implantation, MVAΔE5R-hFl3L-mOX40L ($4\times10^7$ PFU) was delivered into the larger tumors on the right flank twice weekly, with concomitant intraperitoneal (IP) injection of with anti-PD-L1 (250 μg per mouse). Tumor sizes were measured twice a week and mice survival were monitored (FIG. 130). The volumes of injected and non-injected tumors of individual mouse are shown in FIG. 131A-131B). In mice treated with PBS, tumors grew rapidly, which resulted in early death with a median survival of 12.5 days (FIGS. 131A-132B). Intratumoral injection of MVAΔE5R-hFl3L-mOX40L resulted in delayed tumor growth and improved survival compared with PBS, with an extension of median survival to 25 days (FIGS. 131A-131B). Mice treated with the combination of intratumoral delivery of MVAΔE5R-hFl3L-mOX40L and intraperitoneal delivery of anti-PD-L1 were all surviving at the time of last survey. Seven out of nine mice were tumor free and were expected to be cured of B16-f10 melanoma (FIGS. 131A-131B). Based on previous combination therapy of IT MVAΔC7L-hFl3L-TK(−)-mOX40L and systemic delivery of anti-CTLA-4 or anti-PD-L1 in both bilateral tumor model or a large established tumor model, without being bound by theory, it is expected that the combination of IT delivery of MVAΔE5R-hFl3L-mOX40L and systemic delivery of anti-anti-CTLA-4 or anti-PD-1 should generate superior results compared with IT virus alone in both bilateral tumor model or a large established tumor model.

Example 106: MVAΔE5R-hFlt3L-OX40L induces higher levels of IFNB gene expression compared with MVA.

The induction of IFNB gene expression and IFN-β secretion by MVAΔE5RhFlt3L-hOX40LhOX40L vs. MVA-infected BMDCs was examined. Briefly, BMDCs ($1\times10^6$) were infected with either MVAΔE5RhFlt3L-hOX40LhOX40L or MVA at a MOI of 10. Cells were washed after 1 h infection and fresh medium was added. Cells were collected at 6 h post infection and supernatants were collected at 19 h post infection. IFNB gene expressions was determined by RT-PCR (FIG. 132A). IFN-β protein levels in the supernatants were determined by ELISA (FIG. 132B). RT-PCR results show that MVAΔE5RhFlt3L-hOX40LhOX40L strongly induces IFNB gene expression and IFN-β secretion (FIGS. 132A and B).

Example 107: Ex vivo infection with MVAΔE5R-hFlt3L-hOX40L

Extramammary Paget's disease (EMPD) is a rare, slow growing, skin cancer, which occurs in the epithelium and often originates from apocrine glandular cells at the vulva, scrotum, or perianal area. It is usually limited to the epithelium, but it can progress and become invasive. The treatment option is often limited, which includes surgery, radiotherapy, topical imiquimod, photodynamic therapy. How ex vivo culture of biopsy specimen with MVAΔE5R-hFlt3L-hOX40LhOX40L affects the phenotype of tumor-infiltrating lymphocytes in EMPD was analyzed. Briefly, tumor tissues were cut into small pieces with sharp razors and infected with MVAΔE5R-hFlt3L-hOX40LhOX40L at a MOI of 10. After two days of infection, tissues were digested with collagenase D () at 37° C. for 45 min. Cells were filtered and stained with anti-CD3, CD4, CD8 antibodies and were subsequently permeabilized and stained with anti-Granzyme B, and FoxP3 antibodies. FACS analysis was performed. Representative dot plots of Granzyme $B^+CD8^+$ T cells and $FoxP3^+CD4^+$ T cells are shown (FIG. 133A and 133B). FIG. 134A shows a graph of percentages of $Granzyme^+CD8^+$ T cells out of $CD8^+$ cells after infection with MVAΔE5R-hFlt3L-hOX40LhOX40L or PBS control for two days. Data are means ±SEM (n=3). FIG. 134B shows a graph of percentages of $FoxP3^+CD4^+$ T cells T cells out of $CD4^+$ cells after infection with MVAΔE5R-hFlt3L-hOX40LhOX40L or PBS control for two days. Data are means ±SEM (n=3). These results show that ex vivo infection of EMPD with MVAΔE5R-hFlt3L-hOX40LhOX40L results in the increase of the percentages of $Granzyme^+CD8^+$ T cells out of $CD8^+$ cells and the reduction of the percentages of $FoxP3^+CD4^+$ T cells out of $CD4^+$ cells (FIG. 134A and 134B), supporting immune-stimulating function of MVAΔE5R-hFlt3L-hOX40LhOX40L. Accordingly, these results demonstrate that the recombinant poxviruses of the present technology are useful in methods for treating solid tumors.

Example 108: Generation of MVAΔE3LΔE5R and MVAΔE3LΔE5R hFlt3L-mOX40L recombinant viruses In order to test whether deletion of vaccinia E3L gene from MVAΔE5R or MVAΔE5RhFlt3L-mOX40L improves the immunogenicity of the viruses, MVAΔE3LΔE5R and MVAΔE3LΔE5R hFl3L-mOX40L were generated. The process consisted of multiple steps. In the first step, MVAΔE5R and MVAΔE5R hFl3L-mOX40L were generated through homologous recombination at the E4 and E6 loci of the MVA genome (FIGS. 135A and 135B). In the second step, an E3L-mCherry FRT construct was used to remove endogenous E3L from the recombinant viruses through homologous recombination at the E2L and E4L loci (FIG. 135C). The proper integration and purity of the mCherry construct inserted into the E3L locus was confirmed by PCR. The resulting virus lacked both E3L and E5R genes. In order to facilitate later steps in engineering, FRT sites were included in the construct used for E3L deletion. That construct had one FRT site proximal to the p7.5 promoter and another FRT site distal to mCherry. In the third step, this virus was allowed to replicate in cells expressing Flp recombinase in order to remove the mCherry from the viral genome, when further engineering of the virus was desired.

Example 109: MVAΔE3LΔE5R induces higher levels of IFNB gene expression in BMDCs compared with MVAΔE5R and the induction is largely dependent on cGAS.

Vaccinia E3 is an important virulence factor with a N-terminal Z-DNA and C-terminal dsRNA-binding domains. Intranasal infection of VACVΔE3L is non-pathogenic in an intranasal infection model. MVAΔE3L induces higher levels of type I IFN compared with MVA (Dai et al., Plos Pathogens 2014). To test whether MVAΔE3LΔE5R induces higher levels of type I IFN compared with MVAΔE5R, Heat-iMVA, or MVA, BMDCs ($1\times10^6$) from WT C57BL/6J and cGAS$^{-/-}$ mice were infected with either MVAΔE3LΔE5R, MVAΔE5R, Heat-iMVA, or MVA at a MOI of 10. Cells were collected at 6 h post infection. IFNB gene expression was determined by RT-PCR. The results show that MVAΔE3LΔE5R induces higher levels of IFNB gene expression compared with MVAΔE5R in WT BMDCs. Whereas MVAΔE5R-induced IFNB gene expression is completely lost in cGAS$^{-/-}$ cells, MVAΔE3LΔE5R-induced IFNB gene expression is largely reduced in cGAS$^{-/-}$ cells, suggesting that additional pathway such as the MDA5/MAVS-mediated cytosolic dsRNA-sensing pathway might play a minor role in detecting dsRNA produced by this virus in BMDCs (FIG. 136).

Example 110: MVAΔE3LΔE5R infection of murine B16-F10 melanoma cells strongly induces IFNB gene expression and IFN-β protein secretion.

Whether MVAΔE3LΔE5R and MVAΔE5 could induce IFNB gene expression and protein secretion in murine B16-F10 melanoma cells was tested. B16-F10 cells were infected with either MVAΔE3L, MVAΔE5R or MVAΔE3LΔE5R at a MOI of 10. Cells were collected at 15 h post infection. Supernatants were collected at 24 h post infection. RT-PCR analysis showed that MVAΔE3LΔE5R infection of B16-F10 murine melanoma cells induces very strong induction of IFNB (4000 fold) compared to MVAΔE3L or MVAΔE5R (300 or 50-fold respectively). This difference was highly significant ($p<0.0001$) (FIG. 137A). This indicates that the deletions of E3L and E5R genes have a synergistic effect. ELISA results showed that MVAΔE3LΔE5R infection of B16-F10 cells induces much higher levels of IFN-β protein levels in the supernatants of infected cells compared with those infected with MVAΔE3L (3498 pg/ml vs. 479 pg/ml, respectively). MVAΔE5R fails to induce IFN-β protein secretion in B16-F10 cells. To test which nucleic acid-sensing pathways are important for detecting MVAΔE3LΔE5R infection in B16-F10 cells, MDA5$^{-/-}$ and MDA5$^{-/-}$Sting$^{-/-}$ B16-F10 cell lines were generated using CRISPR-cas9 and validated the loss of the respective proteins and genes using both Western Blot against targeted proteins and sequencing of targeted exons. These results show that the strong induction of IFNB by MVAΔE3LΔE5R is largely MDA5-dependent as shown by markedly reduced levels in MDA5$^{-/-}$ cells in RT-PCR and ELISA.

Example 111: MVAΔE3LΔE5R-hFlt3L-mOX40L infection of murine B16-F10 melanoma cells strongly induces hFlt3L and mOX40L expression on the surface of infected cells.

To test whether deletion of the E3L gene affected the expression of hFl3L or mOX40L, B16-F10 cells were infected with either MVAΔE3LΔE5R-hFl3L-mOX40L, MVAΔE5R-hFl3L-mOX40L, or MVAΔE3LΔE5R for 1 h. Cells were washed and incubated in fresh medium and harvested 24 hour later. Cells were stained with anti-hFl3L and anti-mOX40L antibodies and FACS was performed. FIG. 138 shows representative dot plots from FACS demonstrating the expression of mOX40L or hFl3L cells on the surface of B16-F10 cells infected with either MVAΔE3LΔE5R hFl3L-mOX40L or MVAΔE5R hFl3L-mOX40L. The control virus MVAΔE3LΔE5R-infected B16-F10 cells fail to express hFl3L and mOX40L as expected. These results indicate that deletion of the E3L gene fails to affect the expression of the two transgenes hFl3L and mOX40L.

Example 112: Intratumoral delivery of MVAΔE3LΔE5R-hFlt3L-mOX40L induces stronger antitumor systemic T cell responses compared with MVAΔE5R-hFlt3L-mOX40L.

Given that infection of BMDCs and B16-F10 with MVAΔE3LΔE5R induces stronger type I IFN production compared with MVAΔE5R through activating both the cytosolic DNA-sensing pathway mediated by cGAS/STING and the cytosolic dsRNA-sensing pathway mediated by MDA5/MAVS, without being bound by theory, it is hypothesizes that IT delivery of MVAΔE3LΔE5R-hFl3L-mOX40L virus would induce stronger antitumor immune responses. To test that, B16-F10 melanoma cells were implanted intradermally to the left and right flanks of C57B/6J mice ($5\times10^5$ to the right flank and $2.5\times10^5$ to the left flank). Seven days post tumor implantation, $2\times10^7$ pfu of either MVAΔE5R-hFl3L-mOX40L, MVAΔE3LΔE5R-hFl3L-mOX40L, an equivalent amount of Heat-iMVA, or PBS was intratumorally (IT) injected into the larger tumors on the right flank twice, three days apart. Spleens were harvested at 2 days post second injection, ELISPOT analyses were performed to evaluate tumor-specific T cells in the spleens. ELISPOT assay was performed by co-culturing irradiated B16-F10 cells (150,000) and splenocytes (1,000,000) in a 96-well plate. FIG. 139A shows the image of ELISPOT of triplicate samples of combined splenocytes from mice in the same treatment group. FIG. 139B shows a graph of IFN-$\gamma^+$ spots per 1,000,000 splenocytes. These results show that IT MVAΔE3LΔE5R-hFl3L-mOX40L generated the strongest antitumor T cell responses in the spleens of treated mice compared with either MVAΔE5R-hFl3L-mOX40L, or HeatiMVA. These results suggest that the activation of cytosolic dsRNA-sensing pathway mediated by MDA5/MAVS in the tumors might be important for generating strong antitumor adaptive immune responses.

Example 113: Intratumoral delivery of MVAΔE3LΔE5R-hFlt3L-mOX40L delays B2M-deficient B16-F10 cells.

Mutations in Beta 2 microglobulin (B2M) gene have been observed in tumors that relapse with resistance after immune checkpoint blockade therapy. To test whether MVAΔE3LΔE5R-hFl3L-mOX40L is efficacious against such tumors, a B2M deficientB B16F10 tumor model was generated using CRISPR-cas9 technology. Beta 2 Microglobulin (B2M) is an essential component of the MHC Class I complex. FACS analysis confirmed that only cells transfected with anti-B2M gRNAs lost surface MHC at high frequency, indicating an effective CRISPR (data not shown). Cell sorting was used to isolate cells lacking surface MHC class I. A single clonal isolate from this sorting was selected for sequencing and subsequent in vivo experiments. This $B2M^{-/-}$ clonal isolate had a 178 BP deletion in exon 2 of B2M which eliminates half the coding sequence of B2M and creates a frame shift (data not shown).

WT and $B2M^{-/-}$ B16-F10 melanoma cells ($2.5\times10^5$) were implanted intradermally to the right flanks of C57B/6J mice. In order for B2M tumors to implant successfully, NK cells were depleted using PK136 antibody (200 μg/mouse on days—1, 2 and 5) in mice implanted with either WT or $B2M^{-/-}$ B16-F10 cells. Tumors were allowed to grow for 10 days.

Afterwards, $4\times10^7$ pfu of MVAΔE3LΔE5R hFl3L-mOX40L or PBS was intratumorally (IT) injected twice weekly. The tumor sizes were measured and the survival of mice was monitored (FIG. 140).

FIGS. 141A shows tumor volumes of the injected WT and $B2M^{-/-}$ B16-F10 tumors in mice treated with either PBS or MVAΔE3LΔE5R-hFlt3L-mOX40L intratumorally. Both WT and $B2M^{-/-}$ B16-F10 tumors responded to MVAΔE5R-hFlt3L-mOX40L treatment with delaying of tumor growth. FIGS. 141B shows the Kaplan Meier survival curve of the four groups. IT MVAΔE3LΔE5R hFlt3L-mOX40L virus generated an unequivocal survival benefit to mice bearing B2M deficient or WT B16-F10 tumors. By day 24, none of the untreated mice survived while all of the mice bearing $B2M^{-/-}$ tumors treated with MVAΔE3LΔE5R-hFlt3L-mOX40L were alive. Accordingly, these results demonstrate that the recombinant poxviruses of the present technology are useful in methods for treating solid tumors.

Example 114: Intratumoral (IT) injection of MVAΔE3LΔE5R-hFlt3L-mOX40L induces $CD8^+$ T cell activation and proliferation in the injected tumors in AT3 triple negative breast cancer model To compare the immune responses induced by IT injection of MVAΔE5R-hFl3L-mOX40L and MVAΔE3LΔE5R-hFl3L-mOX40L in breast tumors, a bilateral AT3 murine breast tumor implantation model was used (FIG. 142). Briefly, $1\times10^5$ AT3 cells were implanted to the $4^{th}$ fat pad of a C57BL/6J mouse. 12 days post tumor implantation, $6\times10^7$ pfu of MVAΔE5R-hFl3L-mOX40L, or MVAΔE3LΔE5R-hFl3L-mOX40L, or PBS were intratumorally injected twice, three days apart. Two days post second injection, the injected tumors were harvested and cells were processed for surface labeling with anti-CD3, CD45, CD4, CD8 and OX40 antibodies, and also for intracellular Granzyme B, Ki67 and FoxP3 staining. The live immune cell infiltrates in the tumors were analyzed by FACS. IT MVAΔE5R-hFl3L-mOX40L or MVAΔE3LΔE5R-hFl3L-mOX40L induces higher percentage of $CD8^+$ T cells out of $CD45^+$ cells (FIG. 143B) compared with PBS. The absolute number of $CD8^+$ T cells with IT MVAΔE3LΔE5R-hFl3L-mOX40L was higher compared with PBS and MVAΔE5R-hFl3L-mOX40L (FIG. 143C). Both MVAΔE5R-hFl3L-mOX40L or MVAΔE3LΔE5R-hFl3L-mOX40L increased the percentage of Granzyme $B^+$ $CD8^+$ T cells compared with PBS (FIG. 143A, D). The absolute number of Granzyme $B^+$ $CD8^+$ T cells with IT MVAΔE3LΔE5R-hFl3L-mOX40L was higher compared with PBS and MVAΔE5R-hFl3L-mOX40L (FIG. 143E). IT MVAΔE3LΔE5R-hFl3L-mOX40L also induced higher percentage and absolute number of $Ki67^+$ $CD8^+$ T cells (FIG. 144A-C). These results demonstrate that IT MVAΔE3LΔE5R-hFl3L-mOX40L is more effective in activating CD8 T cells and promoting $CD8^+$ T cell proliferation compared with IT MVAΔE5R-hFl3L-mOX40L in AT3 breast cancer model. Accordingly, these results demonstrate that the viral constructs of the present technology are useful in methods for treating solid tumors.

Example 115: Intratumoral (IT) injection of MVAΔE3LΔE5R-hFlt3L-mOX40L activates $CD4^+$ T cell and reduces regulatory T cells in the injected tumors in AT3 triple negative breast cancer model To compare the immune responses induced by IT injection of MVAΔE5R-hFl3L-mOX40L and MVAΔE3LΔE5R-hFl3L-mOX40L in breast tumors, a bilateral AT3 murine breast tumor implantation model was used as described in Example 114 (FIG. 142). After IT MVAΔE5R-hFl3L-mOX40L or IT MVAΔE3LΔE5R-hFl3L-mOX40L, the percentage of total $CD4^+$ T cells out of $CD3^+$ T cells did not change compared with PBS (FIG. 145B) but the absolute number of $CD4^+$ T cells increased significantly after virus injection (FIG. 145C). IT MVAΔE3LΔE5R-hFl3L-mOX40L also generated more Granzyme $B^+CD4^+$ T cells compared with MVAΔE5R-hFl3L-mOX40L or PBS (FIG. 145E). Both IT MVAΔE5R-hFl3L-mOX40L or IT MVAΔE3LΔE5R-hFl3L-mOX40L resulted in significantly reduced percentage of $CD4^+FoxP3^+$ T cells compared with PBS (FIG. 146A, 146B). The percentage of $OX40^+CD4^+$ $FoxP3^+$ T cells reduced after virus injection (FIG. 147A-C). These results demonstrate that IT MVAΔE3LΔE5R-hFl3L-mOX40L induces $CD4^+$ T cell activation and reduces regulatory T cells in AT3 breast cancer model. Accordingly, these results demonstrate that the recombinant poxviruses of the present technology are useful in methods for treating solid tumors.

Example 116: Intratumoral (IT) injection of MVAΔE3LΔE5R-hFlt3L-mOX40L reduces macrophages and DCs in the injected tumors in AT3 triple negative breast cancer model.

To assess whether IT MVAΔE3LΔE5R-hFl3L-mOX40L affects myeloid cell population in breast tumors, a bilateral AT3 murine breast tumor implantation model was used as described in Example 114 (FIG. 142). Two days post second injection, the injected tumors were harvested and cells were processed for surface labeling with anti-CD3, CD19, CD49b, CD45, MHC-II, CD11c, Ly6G, F4/80, Ly6C and CD24 antibodies. The live immune cell infiltrates in the tumors were analyzed by FACS. IT MVAΔE3LΔE5R- hFl3L-mOX40L resulted in significantly reduced percentage and number of macrophages out of total $CD45^+$ cells compared with PBS (FIG. 148A, B). The percentage of dendritic cells was reduced with IT MVAΔE3LΔE5R-hFlt3L-mOX40L and IT MVAΔE5R-hFlt3L-mOX40L (FIG. 148C), with decreased percentage of both $CD11b^+$ and $CD103^+$ DCs (FIG. 148E-H). These results demonstrate that IT MVAΔE3LΔE5R-hFlt3L-mOX40L reduces macrophages and DCs in the injected tumors in AT3 breast cancer model. Accordingly, these results demonstrate that the recombinant poxviruses of the present technology are useful in methods for treating solid tumors.

Example 117: Spontaneous breast cancers are responsive to the combination therapy with IT MVAΔE3LΔE5R-hFlt3L-mOX40L and systemic delivery of anti-PD-L1 and anti-CTLA-4 antibodies.

To evaluate therapeutic efficacy of IT MVAΔE3LΔE5R-hFl3L-mOX40L in combination with anti-PD-L1 and anti-CTLA-4 antibody in triple negative breast cancers, a MMTV-PyMT spontaneous breast cancer model was used. After the first tumor became palpable, injection of MVAΔE5R-hFl3L-mOX40L to tumors was started. 250 μg Anti-PD-L1 and 100 μg anti-CTLA-4 antibodies were given intraperitoneally to each mouse. Tumor sizes were measured twice a week (FIG. 149). The combo treatment resulted in delayed tumor growth compared with PBS control group week (FIG. 150). This result demonstrates that spontaneous breast cancers are responsive to the combination therapy with IT MVAΔE3LΔE5R-hFl3L-mOX40L and systemic delivery of anti-PD-L1 and anti-CTLA-4 antibodies. Accordingly, these results demonstrate that the recombinant poxvirus compositions of the present technology are useful in methods for treating solid tumors.

Example 118: Generation of MVAΔE5R hFlt3L-mOX40LΔC11R recombinant virus

The vaccinia C11R encodes vaccinia growth factor. The WT vaccinia (Western Reserve) genome has two copies, whereas the MVA genome has one copy. The C11 gene was identified as one of the eight vaccinia early genes involved in inhibiting the cGAS/STING pathway in a dual-luciferase screening assay (FIGS. 19 and 20). To test whether deletion of the C11R gene from MVAΔE5R-hFl3L-mOX40L enhances type I IFN induction capacity of the virus, a recombinant virus MVAΔE5R-hFl3L-mOX40LΔC11R was generated through homologous recombination at the C17L/C16L and C10L loci of the MVAΔE5R-hFl3L-mOX40L genome (FIG. 151).

Example 119: MVAΔE5R hFlt3L-mOX40LΔC11R induces higher levels of IFNB gene expression and IFN-β protein secretion in BMDCs compared with MVAΔE5R hFlt3L-mOX40L.

To test whether MVAΔE5R-hFl3L-mOX40LΔC11R induces higher levels of type I IFN compared with MVAΔE5R, BMDCs ($1\times10^6$) from WT C57BL/6J mice were infected with either MVAΔE5R-hFl3L-mOX40LΔC11R, or MVAΔE5R, or MVA at a MOI of 10. Cells were collected at 6 h post infection. Supernatants were collected at 19 h post infection. IFNB gene expression was determined by RT-PCR. The results show that MVAΔE5R-hFl3L-mOX40LΔC11R induces higher levels of IFNB gene expression compared with MVAΔE5R (FIG. 152A).

IFN-β protein levels in the supernatants were determined by ELISA (FIG. 152B). The results show that MVAΔE5R-hFl3L-mOX40LΔC11R infection of BMDCs induce higher levels of IFN-β protein secretion compared with MVAΔE5R. These results indicate that removing the C11R gene from MVAΔE5R-hFl3L-mOX40L further improves IFN induction capacity of the viruses.

Example 120: Generation of MVAΔWR199 and MVAΔE5R hFlt3L-mOX40LΔWR199 recombinant viruses.

The vaccinia WR199 gene encodes a 68-Kda ankyrin-repeat protein, and is one of the eight vaccinia early genes identified in the screening for inhibitors of cGAS/STING pathway (FIG. 19). To test whether deletion of the WR199 gene from MVA or MVAΔE5R-hFl3L-mOX40L enhances type I IFN induction capacity of the viruses respectively, recombinant viruses MVAΔWR199 and MVAΔE5R-hFl3L-mOX40LΔWR199 were generated through homologous recombination at the B17L and B19R loci of the MVA and MVAΔE5R-hFl3L-mOX40L genome (FIG. 153). FRT sites were placed at the flanking region of the gene encoding mcherry to facilitate fluorescent color removal for further engineering of the virus.

Example 121: Deletion of the WR199 gene from MVA or MVAΔE5R hFlt3L-mOX40L improves IFNB gene induction capacity of the viruses in BMDCs.

To whether deleting the WR199 gene from MVA or MVAΔE5R-hFl3L-mOX40L induces higher levels of type I IFN, BMDCs ($1\times10^6$) from WT and $cGAS^{-/-}$ C57BL/6J mice were infected with either MVA or MVAΔWR199 at a MOI of 10 or with Heat-iMVA at an equivalent amount. Cells were collected at 6 h post infection. Supernatants were collected at 19 h post infection. IFNB gene expression was determined by RT-PCR. The results show that MVAΔWR199 induces higher levels of IFNB gene expression compared with MVA, but lower levels of IFNB compared with Heat-iMVA in BMDCs (FIG. 154A). In $cGAS^{-/-}$ BMDCs, MVAΔWR199-induced IFNB gene induction is completely lost (FIG. 154A).

Four isolated clones of MVAΔE5R-hFl3L-mOX40LΔWR199. BMDCs were generated and cells were infected with either one of the four clones, MVAΔWR199, or MVAΔE5R. RT-PCR analysis showed that MVAΔE5R-hFl3L-mOX40LΔWR199 induces higher levels of IFNB gene expression compared with MVAΔE5R or MVAΔWR199 (FIG. 154B).

IFN-β protein levels in the supernatants were determined by ELISA (FIG. 154C). The results show that MVAΔ5R-hFl3L-mOX40LΔWR199 infection of BMDCs induces higher levels of IFN-β protein secretion compared with MVAΔE5R or MVAΔWR199. These results indicate that removing the WR199 gene from either MVA or MVAΔE5R-hFl3L-mOX40L further improves IFN induction capacity of the viruses.

Example 122: Generation of recombinant vaccinia virus with deletion of B2R (VACVΔB2R).

It was recently reported that the vaccinia B2R gene encodes a nuclease that degrades 240 ,3'-cyclic GMP-AMP (cGAMP), which contributes to immune evasion of the cytosolic DNA-sensing pathway mediated by cGAS (Eaglesham et al., 2019). This gene is highly conserved among the poxvirus family. However, the B2R gene in MVA is truncated and the protein is inactive. A mutant vaccinia with B2R deletion from vTF7-3 Western Reserve strain, in which the vaccinia thymidine kinase gene (TK) was generated and was found to be more attenuated than the parental virus in a skin scarification model. To test the effect of B2R gene deletion on viral virulence independent of TK deletion, a VACVΔB2R mutant virus was generated and evaluated the virulence of the virus in an intranasal infection model.

Briefly, pB2R -FRT GFP vector were used to insert GFP under the control of the vaccinia P7.5 promoter into the B2R locus of vaccinia virus (VACV; Western Reserve strain). The expression cassette is flanked by partial sequence of the B1R and B3R genes on either side (FIG. 155). BSC40 cells were infected with WT vaccinia virus at a MOI of 0.05 for 1 h, and then were transfected with the plasmid DNA described above. The infected cells were collected at 48 h. Recombinant viruses were identified by their green fluorescence with the insertion of GFP into the B2R locus. The positive clones were plaque purified 4-5 times on BSC40 cells. PCR analysis were performed to confirm that the recombinant virus VACVΔB2R has lost the B2R gene.

Example 123: The vaccinia B2R gene encodes a virulence factor.

To determine whether the vaccinia virus B2R gene contributes to virulence in an intranasal infection model, groups of 6-week-old WT female C57BL/6J mice were intranasally infected with two different doses ($2\times10^7$ or $2\times10^6$ pfu) of VAVCΔB2R. Weight loss and survival of C57BL/6J mice after intranasal infection with VACVΔB2R were monitored. Infection of VACVΔB2R at either dose resulted in maximal weight loss (around 20% of the initial weight) around day 6 post infection. The mice regained their weight at day 13 post infection and all of them survived (FIGS. 156A and B). These results suggested that VAVCΔB2R is highly attenuated in the intranasal infection model compared with WT VACV, which has a $LD_{50}$ of $2\times10^5$ pfu.

Example 124: Generation of recombinant vaccinia viruses VACVΔE5RΔB2R and VACVΔE3L83NΔE5RΔB2R.

To test the effect of compound deletions of both B2R and E5R genes from either WT VACV background or VACVΔE3L83N, which lacks the DNA fragment encoding the N-terminal 83 amino acid Z-DNA binding domain, VACVΔE5RΔB2R and VACVΔE3L83NΔE5RΔB2R were generated. Briefly, pB2R -FRT GFP vector were used to insert GFP under the control of the vaccinia P7.5 promoter into the B2R locus of mutant vaccinia virus VACVΔE5R (FIG. 157A), or VACVΔE3L83NΔE5R (FIG. 157B), which was generated by deleting E5R gene from VACVΔE3L83N virus. The expression cassette is flanked by partial sequence of the B1R and B3R genes on either side (FIG. 157).

BSC40 cells were infected with either VACVΔE5R or VACVΔE3L83ΔE5R at a MOI of 0.05 for 1 h, and then were transfected with the plasmid DNAs described above. The infected cells were collected at 48 h. Recombinant viruses were identified by their green fluorescence with the insertion of GFP into the B2R locus. The positive clones were then plaque purified 4-5 times on BSC40 cells. PCR analysis were performed to confirm that recombinant viruses VACVΔE5RΔB2R and VACVΔE3L83NΔE5RΔB2R have lost the B2R gene.

Example 125: Recombinant vaccinia viruses VACVΔE5RΔB2R and VACVΔE3L83NΔE5RΔB2R are highly attenuated in a murine intranasal infection model.

Intranasal infection of 6-week-old WT female C57BL/6J mice was performed with $2\times10^7$ pfu of VACVΔE5R, VACVΔB2R, VACVΔE3L83NΔE5R, VACVΔE5RΔB2R, or VACVΔE3L83NΔE5RΔB2R. Weight loss and survival of the mice were monitored (FIG. 158). Infection with VACVΔE3L83NΔE5RΔB2R resulted the least weight loss in these mice, with maximum weight loss around 10% of the initial weight (FIG. 158). Infection with VACVΔE5RΔB2R also resulted less weight loss compared with the VACVΔE5R or VACVΔB2R (FIG. 158). All of mice survived the infection. These results indicate that compound deletion of B2R and E5R or B2R, E5R, and E3L83N results in further attenuation of the viruses.

Example 126: VACVΔE5RΔB2R or VACVΔE3L83NΔE5RΔB2R infection of bone marrow-derived dendritic cells (BMDCs) induces higher levels of type I IFNB gene expression and IFN-β protein secretion than VACVΔB2R, or VACVΔE5R.

Vaccinia E5R gene expression leads to cGAS degradation (Example 63 and 64). The vaccinia B2R gene encodes a nuclease that degrades cGAMP, which is a product of cGAS. Without being bound by theory, it is hypothesized that double deletion of B2R and E5R gene from the vaccinia genome can lead enhanced induction of IFNB gene expression and IFN-β protein secretion in infected BMDCs.

To test that, WT and $cGAS^{-/-}$ BMDCs were infected with VACVΔE3L83NΔE5R, VACVΔE5RΔB2R, VACVΔE3L83NΔE5RΔB2R, VACVΔE3L83N, VACVΔB2R, or VACVΔE5R at a MOI of 10 or with an equivalent amount of Heat-iMVA. Cells were collected at 6 h post infection. RNAs were extracted. The IFNB gene expression levels were determined by quantitative PCR analyses. Supernatants were collected at 24 h post infection and IFN-β levels were measured by ELISA. RT-PCR results showed that whereas WT VACV infection of BMDCs induced 225-fold higher levels of IFNB gene expression compared with no-treatment control, and VACVΔE3L83N, VACVΔB2R, or VACVΔE5R, VACVΔE3L83NΔE5R infection induced 223-, 410-, 3054-, 3117-fold higher levels of IFNB gene expression compared with no-treatment control, respectively. VACVΔE5RΔB2R or VACVΔE3L83NΔE5RΔB2R infection induced 9970-and 10383-fold higher levels of IFNB gene expression compared with no-treatment control (FIG. 159A). ELISA results showed that VACVΔB2R, VACVΔE5R, or VACVΔE3L83NΔE5R infection of BMDCs induced IFN-β protein secretion from BMDCs resulting in IFN-β levels in the supernatants at 22, 232, and 189 pg/ml respectively. VACVΔE5RΔB2R or VACVΔE3L83NΔE5RΔB2R infection induced higher level of IFN-β secretion with the IFN-β at 700 and 763 pg/ml in the supernatants (FIG. 159B). In the $cGAS^{-/-}$ BMDCs, the attenuated vaccinia fails to induce IFNB gene expression or IFN-β protein secretion (FIGS. 159A and 159B).

These results indicate that the combined deletion of B2R and E5R induces higher levels of IFNB gene expression and IFN-β protein secretion from BMDCs compared with single B2R or E5R deletion. And the induction of IFNB gene expression and IFN-β protein secretion from BMDCs infected with the attenuated mutant vaccinia is recombinant oxviruses of the present technology are useful in methods for treating solid tumors.

Example 127: VACVΔE5RΔB2R or VACVΔE3L83NΔE5RΔB2R infection of bone marrow-derived dendritic cells (BMDCs) induces higher levels of phosphorylation of STING, TBK1 and IRF3 compared with VACVΔB2R, or VACVΔE5R.

To test whether the double deletions of B2R and E5R from WT VACV genome or the triple deletions of E3L83N, B2R, and E5R from WT VACV genome would induce stronger activation of the cGAS-STING signaling pathway, BMDCs were infected with VACV, VACVΔB2R, VACVΔE5R, VACVΔE3L83NΔE5R, VACVΔE5RΔB2R, or VACVΔE3L83NΔE5RΔB2R at a MOI of 10. Cell lysates were collected at 2, 4, and 6 h post infection. Proteins were separated in SDS-PAGE gel, and were blotted with antibodies against phosphorylated STING, TKB1, and IRF3. VACVΔE5RΔB2R or VACVΔE3L83NΔE5RΔB2R induced higher levels of phosphorylation of STING, TBK1,and IRF3 in infected BMDCs compared with VACVΔB2R or VACVΔE5R (FIG. 160). These results indicate that the double deletions of B2R and E5R from WT VACV genome or the triple deletions of E3L83N, B2R, and E5R from WT VACV genome results in stronger activation of the cGAS/STING/TBK1/IRF3 signaling pathway.

Example 128: Generation of the recombinant vaccinia viruses VACVΔE3L83N-ΔTK-anti-muCTLA-4-ΔE5R-hFlt3L-mOX40L-mIL-12 (OV-VACVΔE5R) or VACVΔE3L83N-ΔTK-anti-muCTLA-4-ΔE5R-hFlt3L-mOX40L-mIL-12-ΔB2R (OV-VACVΔB2R).

This example describes the generation of the recombinant VACVΔE3L83N-ΔTK-anti-muCTLA-4-ΔE5R-hFlt3L-mOX40L-mIL-12 or VACVΔE3L83N-ΔTK-anti-muCTLA-4-ΔE5R-hFlt3L-mOX40L-mIL-12-ΔB2R viruses.

FIG. 161 shows the stepwise strategy to generate recombinant VACVΔE3L83NΔTKΔE5R virus expressing anti-muCTLA-4, hFl3L, mOX40L and mIL12 proteins through homologous recombination first at the TK locus and then at the E5R locus of the VACVΔE3L83N genome. pCB-anti-muCTLA-4 gpt vector was used to insert a single expression cassette to express the anti-muCTLA-4 antibody heavy and light chains under the control of the vaccinia virus synthetic early and late promoter (PsE/L). Homologous recombination that occurred at the TK-L and TK-R sites results in the insertion of expression cassette of anti-CTLA-4 antibody into TK locus on VACVΔE3L83N genome, generating the recombinant virus VACVΔE3L83N-ΔTK-anti-muCTLA-4.

pUC57-hFl3L-mOX40L-mIL12 mCherry vector was used to insert a single expression cassette designed to express both hFl3L-mOX40L fusion protein and mIL12 protein separately using the vaccinia viral synthetic early and late promoter (PsE/L) in opposite directions. The coding sequence of the hFl3L-mOX40L was separated by a cassette including a furin cleavage site followed by a Pep2A sequence. Homologous recombination at the E4L and E6R loci resulted in the insertion of the expression cassette for hFl3L-mOX40L and mIL12 into the E5L locus of VACVΔE3L83N-ΔTK-anti-muCTLA-4 virus. BSC40 cells were infected with VACVΔE3L83N at a MOI of 0.05 for 1 h, and then were transfected with the plasmid pCB-anti-muCTLA-4 gpt. The infected cells were collected at 48 h. Recombinant viruses were selected through further culturing in selection medium including MPA, xanthine and hypoxanthine, and plaque purified. PCR analysis was performed to verify the insertion of anti-muCTLA-4 gene into the TK locus.

For inserting hFl3L-mOX40L-mIL12 expression cassette into the E5R locus of VACVΔE3L83N-ΔTK-anti-muCTLA-4 virus, BSC40 cells were infected with VACVΔE3L83N-ΔTK-anti-muCTLA-4 at a MOI of 0.05 for 1 h, and then were transfected with the plasmid pUC57-hFl3L-mOX40L-mIL12 mCherry. The infected cells were collected at 48 h. Recombinant viruses were isolated through plaque purification for at least 4-5 rounds by selecting mCherry positive plaques. PCR analysis was performed to verify the insertion of hFl3L-mOX40L-mIL12 gene into the E5R locus.

FIG. 162 shows the generation of VACVΔE3L83N-ΔTK-anti-muCTLA-4-ΔE5R-hFl3L-mOX40L-mIL-12-ΔB2R virus through the deletion of B2R gene from VACVΔE3L83N-ΔTK-anti-muCTLA-4-ΔE5R-hFl3L-mOX40L-mIL-12 virus. pB2R-FRT GFP vector were used to insert GFP under the control of the vaccinia P7.5 promoter into the B2R locus of recombinant virus VACVΔE3L83N-ΔTK-anti-muCTLA-4-ΔE5R-hFl3L-mOX40L-mIL-12. BSC40 cells were infected with VACVΔE3L83N-ΔTK-anti-muCTLA-4-ΔE5R-hFl3L-mOX40L-mIL-12 virus at a MOI of 0.05 for 1 h, and then were transfected with the plasmid DNA described above. The infected cells were collected at 48 h. Recombinant viruses were identified by their green fluorescence with the insertion of GFP into the B2R loci and by mCherry in the parental virus. The positive clones were then plaque purified 4-5 times on BSC40 cells. PCR analysis were performed to confirm that recombinant virus VACVΔE3L83N-ΔTK-anti-muCTLA-4-ΔE5R-hFl3L-mOX40L-mIL-12 virus has lost the B2R gene.

Example 129: VACVΔE3L83N-ΔTK-anti-muCTLA-4-ΔE5R-hFlt3L-mOX40L-mIL-12 and VACVΔE3L83N-ΔTK-anti-muCTLA-4-ΔE5R-hFlt3L-mOX40L-mIL-12-ΔB2R are replication competent in BSC40 cells and B16-F10 melanoma cells.

The replication capacities of VACVΔE3L83N-ΔTK-anti-muCTLA-4-ΔE5R-hFl3L-mOX40L-mIL-12 (OV-VACVΔE5R) and VACVΔE3L83N-ΔTK-anti-muCTLA-4-ΔE5R-hFl3L-mOX40L-mIL-12-ΔB2R (OV-VACVΔE5RΔB2R) in BSC40 cells and murine B16-F10 melanoma cells were determined by infecting them at a MOI of 0.01. Cells were collected at various time points post infection and viral yields (log pfu) were determined by titrating on BSC40 cells. FIG. 163 shows the graphs of viral yields plotted against hours post infection. Both VACVΔE3L83N-ΔTK-anti-muCTLA-4-ΔE5R-hFl3L-mOX40L-mIL-12 and VACVΔE3L83N-ΔTK-anti-muCTLA-4-ΔE5R-hFl3L-mOX40L-mIL-12-ΔB2R replicate efficiently in BSC40 cells and B16-F10 melanoma cells.

Example 130: VACVΔE3L83N-ΔTK-anti-muCTLA-4-ΔE5R-hFlt3L-mOX40L-mIL-12 (OV-VACVΔE5R) and VACVΔE3L83N-ΔTK-anti-muCTLA-4-ΔE5R-hFlt3L-mOX40L-mIL-12-ΔB2R (OV-VACVΔE5RΔB2R) infection of BMDCs induces the expression of type I IFNB gene and the secretion of IFN-β protein.

To test whether the recombinant viruses VACVΔE3L83N-ΔTK-anti-muCTLA-4-ΔE5R-hFl3L-mOX40L-mIL-12 (OV-VACVΔE5R) and VACVΔE3L83N-ΔTK-anti-muCTLA-4-ΔE5R-hFl3L-mOX40L-mIL-12-ΔB2R (OV-VACVΔE5RΔB2R) induce type I IFN production in BMDCs, WT and $cGAS^{-/-}$ BMDCs were infected with these viruses at a MOI of 10. Cells were collected at 6 h post infection. RNAs were extracted. The IFNB gene expression levels were determined by quantitative RT-PCR analyses. Supernatants were collected at 24 h post infection and IFN-β□levels in the supernatants were measured by ELISA. RT-PCR results showed that whereas WT VACV infection of BMDCs induced 225-fold higher levels of IFNB gene expression compared with no-treatment control, VACVΔE3L83N-ΔTK-anti-muCTLA-4-ΔE5R-hFl3L-mOX40L-mIL-12 or VACVΔE3L83N-ΔTK-anti-muCTLA-4-ΔE5R-hFl3L-mOX40L-mIL-12-ΔB2R infection induced 1546-and 5501-fold higher levels of IFNB gene expression, respectively, compared with no-infection control (FIG. 164A). The induction of IFNB gene expression by OV-VACVΔE5RΔB2R or OV-VACVΔE5R was abolished in $cGAS^{-/-}$ BMDCs.

ELISA results showed that VACVΔE3L83N-ΔTK-anti-muCTLA-4-ΔE5R-hFlt3L-mOX40L-mIL-12 or VACVΔE3L83N-ΔTK-anti-muCTLA-4-ΔE5R-hFlt3L-mOX40L-mIL-12-ΔB2R infection of BMDCs induced IFN-β secretion from BMDCs (FIG. 164B). These results indicate that VACVΔE3L83N-ΔTK-anti-muCTLA-4-ΔE5R-hFl3L-mOX40L-mIL-12 (OV-VACVΔE5R) or VACVΔE3L83N-ΔTK-anti-muCTLA-4-ΔE5R-hFl3L-mOX40L-mIL-12-ΔB2R (OV-VACVΔE5RΔB2R) induced higher levels of IFNB gene expression and IFN-β protein secretion than WT VACV from BMDCs. In addition, OV-VACVΔE5RΔB2R infection of BMDCs induces higher levels of IFNB gene expression and IFN-b secretion compared with OV-VACVΔE5R (FIG. 164). Therefore, OV-VACVΔE5RΔB2R is more immune-activating compared with OV-VACVΔE5R.

Example 131: Expression of anti-muCTLA-4-hFlt3L, mOX40L in B16-F10 melanoma cells infected with E3LΔ83N-ΔTK-anti-muCTLA-4-ΔE5R-hFlt3L-mOX40L-mIL12 virus.

To determine whether VACVΔE3L83N-ΔTK-anti-muCTLA-4-ΔE5R-hFl3L-mOX40L-mIL-12 (OV-VACVΔE5R) recombinant virus is capable of expressing desired transgenes, B16-F10 murine melanoma cells were infected with VACVΔE3L83N-ΔTK-anti-muCTLA-4-ΔE5R-hFl3L-mOX40L-mIL-12 (OV-VACVΔE5R) at a MOI of 10. Cell lysates were collected at various times (8, 24, and 48 hours) post infection. Western blot analyses were performed to determine the expression of anti-muCTLA-4 and hFl3L proteins. As shown in FIG.165A, there were abundant expressions of anti-muCTLA-4 antibody and hFl3L in B16-F10 cells infected with VACVΔE3L83N-ΔTK-anti-muCTLA-4-ΔE5R-hFl3L-mOX40L-mIL-12 viruses. B16-F10 murine melanoma cells were also infected with VACVΔE3L83N-ΔTK-anti-muCTLA-4-ΔE5R-hFl3L-mOX40L-mIL-12 at a MOI of 10, and the expression of mOX40L on cell surface were determined by FACS analysis. As shown in FIG. 165B, 99.5% of infected cells expressed mOX40L on cell surface. These results demonstrate that the recombinant poxvirus of the present technology have the capacity to express specific transgenes of interest in infected cells.

Example 132: Intratumorally injected E3LΔ83N-ΔTK-anti-muCTLA-4-ΔE5R-hFlt3L-mOX40L-mIL-12 virus has the capacity to express desired transgenes in implanted tumors in vivo.

A unilateral tumor implantation model was used to assess whether recombinant viruses can express specific transgenes in implanted tumors in vivo. B16-F10 melanoma cells ($5\times10^5$ cells) were intradermally implanted into the shaved skin on the right flank of C57BL/6J mice. Eight days after tumor implantation the tumors (about 4 mm in diameter) were injected with VACVΔE3L83N-ΔTK-anti-muCTLA-4-ΔE5R-hFlt3L-mOX40L-mIL-12 virus. Tumor samples were collected at 48 hours after virus injection. Western blot analyses showed that mIL-12 was detected in tumors treated with the recombinant virus expressing mIL-12, but not in PBS-treated tumors (FIG. 165C). These results demonstrate that the recombinant VACVΔE3L83N-ΔTK-anti-muCTLA-4-ΔE5R-hFlt3L-mOX40L-mIL-12 virus can express desired specific transgenes in injected tumors in vivo.

Example 133: Secretion of mIL-12 from murine B16-F10 melanoma cells, 4T1 breast cancer cells, and MC38 colon cancer cells via infection of E3LΔ83N-ΔTK-anti-muCTLA-4-ΔE5R-hFlt3L-mOX40L-mIL-12 viruses.

To examine whether recombinant viruses infected cells are capable of secreting desired proteins, B16-F10 murine melanoma cells, 4T1 breast cancer cells, and MC38 colon cancer cells were mock infected, or infected with VACV or E3LΔ83N-ΔTK-anti-muCTLA-4-ΔE5R-hFlt3L-mOX40L-mIL-12 (OV-VACVΔE5R) at a MOI of 10. The supernatant was collected at 24 and 48 hours after infection. ELISA was used to measure the concentration of secreted mIL-12 in the supernatant. As shown in FIG. 166, there is high levels of mIL-12 protein in the supernatants of E3LΔ83N-ΔTK-anti-muCTLA-4-ΔE5R-hFlt3L-mOX40L-mIL-12 (OV-VACVΔE5R) virus infected B16-F10 melanoma cells (FIG. 166A), 4T1 breast cancer cells (FIG. 166B), and MC38 colon cancer cells (FIG. 166C). These results demonstrate that OV-VACVΔE5R infection of tumor cells leads to mIL-12 release. To avoid mIL-12 toxicity, extracellular matrix tag were inserted to the C-terminus of IL12 p30 subunit. The coding sequence of p40 and p30 subunits of mIL12 is separated by a furin cleavage site followed by a Pep2A sequence. The C-terminus of p30 subunit is tagged with a matrix binding sequence.

Example 134: Intratumoral injection of E3LΔ83N-ΔTK-anti-muCTLA-4-ΔE5R-hFlt3L-mOX40L-mIL-12 (OV-VACVΔE5R) is more effective than HT-iMVA in a bilateral B16-F10 tumor implantation model.

To test the in vivo tumor killing activities of the recombinant virus E3LΔ83N-ΔTK-anti-muCTLA-4-ΔE5R-hFlt3L-mOX40L-mIL-12, a bilateral tumor implantation model was used. B16-F10 melanoma cells were implanted intradermally into the shaved skin on the right ($5\times10^5$ cells) and left ($1\times10^5$ cells) flanks of a C57BL/6J mouse. After 7 to 8 days post implantation, the larger tumors on the right flank (about 3 mm or larger in diameter) were intratumorally injected twice per week with PBS, HT-iMVA, E3LΔ83N-ΔTK-anti-muCTLA-4-ΔE5R-hFlt3L-mOX40L-mIL-12, or E3LΔ83N-ΔTK-anti-muCTLA-4-ΔE5R-hFlt3L-mOX40L-mIL-12 plus intraperitoneal (IP) injection of anti-PD-L1 antibody (250 μg/mouse). Mice were monitored for survival and the tumor sizes were measured twice a week. FIG. 167A shows the tumor volume and FIG. 167B shows the Kaplan-Meier survival curve of the experiment. FOG. 167B shows that mice with PBS mock-treated tumors grew very quickly and the mice died with a median survival of 14 days. The injection of HT-iMVA into the tumors extended the median survival day to 18 days. Injection of E3LΔ83N-ΔTK-anti-muCTLA-4-ΔE5R-hFlt3L-mOX40L-mIL-12 increase the median survival to 30 days. Intratumoral injection of E3LΔ83N-ΔTK-anti-muCTLA-4-ΔE5R-hFlt3L-mOX40L-mIL-12 plus IP injection of anti-muPD-L1 antibody (250 μg/mouse) also increased the median survival to 30 days. FIG. 167A demonstrate the measured tumor volume over time for injected tumors and non-injected tumors. These results demonstrate that the expression of anti-muCTLA-4, hFlt3L, mOX40L, and mIL-12 by the engineered E3LΔ83N-ΔTK-anti-muCTLA-4-ΔE5R-hFlt3L-mOX40L-mIL-12 virus is capable of reducing tumor volume and slowing tumor growth in both injected and non-injected tumors, thereby demonstrating an abscopal effect. Accordingly, these results demonstrate that the recombinant poxviruses of the present technology are useful in methods for treating solid tumors.

Example 135: Intratumoral delivery of E3LΔ83N-ΔTK-anti-muCTLA-4-ΔE5R-hFlt3L-mOX40L-mIL-12ΔB2R induces stronger antitumor systemic T cell responses compared with E3LΔ83N-ΔTK-anti-muCTLA-4-ΔE5R-hFlt3L-mOX40L-mIL-12 or Heat-iMVA.

Infection of BMDCs with E3LΔ83N-ΔTK-anti-muCTLA-4-ΔE5R-hFl3L-mOX40L-mIL-12-ΔB2R induces stronger type I IFN production compared with E3LΔ83N-ΔTK-anti-muCTLA-4-ΔE5R-hFl3L-mOX40L-mIL-12. Without being bound by theory, it is hypothesized that IT delivery of E3LΔ83N-ΔTK-anti-muCTLA-4-ΔE5R-hFl3L-mOX40L-mIL-12-ΔB2R virus would induce stronger anti-tumor immune responses. To testing whether further deletion of B2R from E3LΔ83N-ΔTK-anti-muCTLA-4-ΔE5R-hFl3L-mOX40L-mIL-12 will enhance the antitumor efficacy, B16-F10 melanoma cells were implanted intradermally to the left and right flanks of C57B/6J mice ($5\times10^5$ to the right flank and $2.5\times10^5$ to the left flank). Seven days post tumor implantation, $2\times10^7$ pfu of either E3LΔ83N-ΔTK-anti-muCTLA-4-ΔE5R-hFl3L-mOX40L-mIL-12-ΔB2R, E3LΔ83N-ΔTK-anti-muCTLA-4-ΔE5R-hFl3L-mOX40L-mIL-12, or an equivalent amount of Heat-iMVA, or PBS was intratumorally injected into the larger tumors on the right flank twice, three days apart. Spleens were harvested at 3 days post second injection, ELISPOT analyses were performed to evaluate tumor-specific T cells in the spleens. ELISPOT assay was performed by co-culturing irradiated B16-F10 cells (150,000) and splenocytes (1,000,000) in a 96-well plate. FIG. 168A shows a graph of IFN-$\gamma^+$ spots per 1,000,000 splenocytes. FIG. 168B shows the image of ELISPOT of triplicate samples of combined splenocytes from mice in the same treatment group. These results show that IT injection of E3LΔ83N-ΔTK-anti-muCTLA-4-ΔE5R-hFl3L-mOX40L-mIL-12-ΔB2R generated the strongest antitumor T cell responses in the spleens of treated mice compared with either E3LΔ83N-ΔTK-anti-muCTLA-4-ΔE5R-hFl3L-mOX40L-mIL-12 or Heat-iMVA.

Example 136: Generation of the recombinant vaccinia viruses with TK-E3L83N-E5R deletions and expressing anti-huCTLA-4, hFlt3L, hOX40L, and hIL-12 (VACVΔE3L83N-ΔTK-anti-huCTLA-4-ΔE5R-hFlt3L-hOX40L-hIL-12).

This example describes the generation of the recombinant VACVΔE3L83N-ΔTK-anti-huCTLA-4-ΔE5R-hFlt3L-hOX40L-IL-12 virus.

FIG. 169 shows the stepwise strategy to generate recombinant VACVΔE3L83NΔTKΔE5R virus expressing anti-huCTLA-4, hFl3L, hOX40L, and hIL12 proteins through homologous recombination first at the TK loci and then at the E5R loci of the VACVΔE3L83N genome. pCB-anti-huCTLA-4 gpt vector was used to insert a single expression cassette to express the anti-huCTLA-4 antibody heavy and light chains under the control of the vaccinia virus synthetic early and late promoter (PsE/L). Homologous recombination that occurred at the TK-L and TK-R sites results in the insertion of expression cassette of anti-huCTLA-4 antibody into TK locus of the VACVΔE3L83N genome, generating the recombinant virus VACVΔE3L83N-ΔTK-anti-huCTLA-4. pUC57-hFlt3L-hOX40LhOX40L-hIL12 mCherry vector was used to insert a single expression cassette designed to express both hFlt3L-hOX40LhOX40L fusion protein and hIL12 protein separately using the vaccinia viral synthetic early and late promoter (PsE/L) in opposite direction. The coding sequence of the hFlt3L-hOX40LhOX40L was separated by a cassette including a furin cleavage site followed by a Pep2A sequence. Homologous recombination at the E4L and E6R loci resulted in the insertion of the expression cassette for hFlt3L-hOX40LhOX40L and hIL12 into the E5L locus of VACVΔE3L83N-ΔTK-anti-huCTLA-4 virus. BSC40 cells will be infected with VACVΔE3L83N at a MOI of 0.05 for 1 h, and then will be transfected with the plasmid pCB-anti-muCTLA-4 gpt. The infected cells will be collected at 48 h after virus infection. Recombinant viruses will be selected through further culturing in selection medium including MPA, xanthine and hypoxanthine, and plaque purified. PCR analysis will be performed to verify the insertion of anti-muCTLA-4 gene into the TK locus. For inserting hFlt3L-hOX40LhOX40L-hIL12 expression cassette into the E5R locus of VACVΔE3L83N-ΔTK-anti-huCTLA-4 virus, BSC40 cells will be infected with VACVΔE3L83N-ΔTK-anti-huCTLA-4 at a MOI of 0.05 for 1 h, and then will be transfected with the plasmid pUC57-hFlt3L-hOX40LhOX40L-hIL12 mCherry. The infected cells will be collected at 48 h after virus infection. Recombinant viruses will be isolated through plaque purification by selecting mCherry positive virus plaques. PCR analysis will performed to verify the insertion of hFlt3L-hOX40LhOX40L-hIL12 gene into the E5R locus. The vaccinia B2R, B18R, and WR199 genes will further be deleted to enhance the innate immune response of this virus.

Example 137: Generation of the recombinant myxoma viruses MyxomaΔM063R and MyxomaΔM064R.

Myxoma M063R (M63R) and M064R (M64R) are orthologs of vaccinia C7. To test whether deletion of M063R or M064R from the parental genome improves IFN induction capacity of Myxoma virus, the inventors generated MyxomaΔM063R and MyxomaΔM064R through homologous recombinations at the homology arms of the transfected plasmids and the parental myxoma viral genome (FIG. 170). pUC57 vector is used to insert a single expression cassette designed to express EGFP using the vaccinia viral synthetic early and late promoter (PsE/L). Homologous recombination that occurred at the M062R and M064R loci results in the insertion of expression cassette for EGFP and the deletion of M063. Similarly, homologous recombination that occurred at the M063R and M065R loci results in the insertion of expression cassette for EGFP and the deletion of M064. Briefly, BGMK cells were infected with the parental myxoma virus MyxomaΔM127-mcherry (Myxoma-mcherry) at a MOI of MOI of 0.05 for 1 h, and then were transfected with the plasmid DNAs described above. The infected cells were collected at 48 h. Recombinant viruses were identified by their green fluorescence with the insertion of EGFP into the M063 or M064 loci and by mCherry in the parental virus. The double positive clones were then purified 6-8 times on BGMK cells. PCR analysis were performed to confirm that recombinant viruses MyxomaΔM063R (ΔM63R) and MyxomaΔM064R (ΔM064R) have lost M063R and M064R genes respectively.

Example 138: MyxomaΔM063R and MyxomaΔM064R induces higher levels of IFNB gene expression and IFN-β protein secretion in BMDCs compared with the parental virus.

To test whether deleting the M063R gene or the M064R gene from the parental myxoma virus (Myxoma-mcherry) induces higher levels of type I IFN, BMDCs ($1\times10^6$) from WT C57BL/6J mice were infected with either Myxoma-mcherry, MyxomaΔM063R, MyxomaΔM064R, or MVA at a MOI of 10. Cells were collected at 6 h post infection. Supernatants were collected at 19 h post infection. IFNB gene expression was determined by RT-PCR. The results show that both MyxomaΔM063R and MyxomaΔM064R induce higher levels of IFNB gene expression compared with Myxoma-mcherry, but lower levels of IFNB compared with MVA in BMDCs (FIG. 171A).

IFN-β protein levels in the supernatants were determined by ELISA (FIG. 171B). The results show that both MyxomaΔM064 and MyxomaΔM063 infection of BMDCs induce higher levels of IFN-β protein secretion compared with Myxoma-mcherry. These results indicate that removing the vaccinia C7 orthologs from myxoma virus further improves IFN induction capacity of the virus.

Example 139: Intratumoral delivery of Myxoma-mcherry or MyxomaΔM064R induces CD8 and CD4 T cell activation in injected tumors two days after treatment in a B16-f10 melanoma model.

To assess whether IT delivery of the parental myxoma virus or MyxomaΔM064R alters immune-suppressive tumor microenvironment, the following experiment was performed. Briefly, B16-F10 melanoma cells were implanted intradermally into the shaved skin on the right ($5\times10^5$ cells) and left ($2.5\times10^5$ cells) flanks of C57BL/6J mice. Seven days post implantation, the larger tumors on the right flank were injected with $4\times10^7$ pfu of Myxoma-mcherry, MyxomaΔM064, or MVAΔE5R, or PBS just once. Two days post injection, tumors were harvested and cells were processed for surface labeling with anti-CD3, CD45, CD4, CD8, and also for intracellular Granzyme B staining. The live immune cell infiltrates in the tumors were analyzed by FACS (FIG. 172). FIG. 173A shows representative dot plots of Granzyme $B^+CD8^+$ T cells. IT Myxoma-mcherry, MyxomΔM064, or MVAΔE5R results in the activation of $CD8^+$ T cells in the injected tumors. FIG. 173B shows that IT Myxoma-mcherry, MyxomΔM064, or MVAΔE5R results in higher numbers of CD45⁺ cells in the injected tumors compared with those treated with PBS. FIG. 173C shows IT Myxoma-mcherry, MyxomaΔM064, or MVAΔE5R results in higher percentages of Granzyme $B^+CD8^+$ cells in the injected tumors compared with those treated with PBS. FIG. 174A shows representative dot plots of Granzyme $B^+CD4^+$ T cells. IT Myxoma-mcherry, MyxomΔM064, or MVAΔE5R results in the activation of $CD4^+$ T cells in the injected tumors. FIG. 174B shows that IT Myxoma-mcherry, MyxomaΔM064, or MVAΔE5R results in higher percentages of Granzyme $B^+CD4^+$ cells in the injected tumors compared with those treated with PBS. These results demonstrate that the recombinant poxviruses of the present technology are useful in methods for treating solid tumors.

EQUIVALENTS

The present technology is not to be limited in terms of the particular embodiments described in this application, which are intended as single illustrations of individual aspects of the present technology. Many modifications and variations of this present technology can be made without departing from its spirit and scope, as will be apparent to those skilled in the art. Functionally equivalent methods and apparatuses within the scope of the present technology, in addition to those enumerated herein, will be apparent to those skilled in the art from the foregoing descriptions. Such modifications and variations are intended to fall within the scope of the appended claims. The present technology is to be limited only by the terms of the appended claims, along with the full scope of equivalents to which such claims are entitled. It is to be understood that this present technology is not limited to particular methods, reagents, compounds, compositions or biological systems, which can, of course, vary. It is also to be understood that the terminology used herein is for the purpose of describing particular embodiments only, and is not intended to be limiting.

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, particularly in terms of providing a written description, all ranges disclosed herein also encompass any and all possible subranges and combinations of subranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like, include the number recited and refer to ranges which can be subsequently broken down into subranges as discussed above. Finally, as will be understood by one skilled in the art, a range includes each individual member. Thus, for example, a group having 1-3 cells refers to groups having 1, 2, or 3 cells. Similarly, a group having 1-5 cells refers to groups having 1, 2, 3, 4, or 5 cells, and so forth.

All patents, patent applications, provisional applications, and publications referred to or cited herein are incorporated by reference in their entirety, including all figures and tables, to the extent they are not inconsistent with the explicit teachings of this specification. Other embodiments are set forth within the following claims.

SEQUENCE LISTING (60 sequences)

SEQ ID NO: 1 - DNA, 177923 bp, Vaccinia virus
gtaagattaaattaattataaaattatgtatataatattaattataaaattatgtatatgatttactaactttagttagataaattaataatacataaattttagtatattaatattataaattaataatacataaattttagtatattaatattatattttaaatatttatttagtgtctagaaaaaaatgtgtgaccaacgaccgtaggaaactctagagggtaagaaaaatcaatcgctttatagagaccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagaataaaaatattttagtgacaccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaccatcgaagagagaaagagaaagagatagttagtctagatatttttcttagtacaaaagtcaatgttttaaaatatatggacaagaatttgtctgtataaaaacttgtgtgaaattttgtaccaaagaaaaaatgtgagcagtatcccctacatggattttactagatcatttatataccaaaaaatattatacgatctacgttttattatatgattttaacgtgtaaattataaacattattttatgatatacaattgtctggtaacctagatgggcataggggatgagtatatgttgttggacgttattgtttaagaaatagttgatgcatcagaaagaggtttaatatttttgtgagaccatcgaagagagaaagagataaaacttttttacgactccatcagaaagaggtttaatatttttgtgagaccatcgaagagagaaagagataaaacttttttatgactccattgaagagagaatgagaataaaaatattttagtgacaccatcagaaagaggtttaatattttttatgagaccatcaaagagagaaagagaataaaaatattttatgactccattgaagagagaaagagaaaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatattttatgactccattgaagagagaaagagaataaaaatattttagtgacaccatcagaaagaggtttaatatttttgtgagaccatcgaagagagaaagagaataaaaatattttatgactccattgaagagagaaagagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaaagagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaaattataaacattattttatgatatacaattgtctggtaacctagatgggcataggggatgttgataagctcgacgagtatatgttgttggacgttattgtttaagaaatagttgatgcatcagaaagagaataaaaaatattttagtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaaagagaataaaaatattttagtgacaccatcagaaagaggtttaatattttttatgagaccatcaaagagagaaagagaataaaaatatttttgtaaaactttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtgagaccatcaaagagagaaagagaataaaaatatttttgtgagaccatcaaagagagaaagagaataaaaatatttttgtgagaccatcaaagagagaaagagaataaaaatattttatgactccattgaagagagaaagagaataaaaatattttagtgacaccatcagaaagaggtttaatatttttgtgagaccatcgaagagagaaagagaataaaaatattttatgactccattgaagagagaaagagaataaaaatattttagtgacaccatcagaaagaggtttaatattttttatgagaccatcaaagagagaaagagaataaaaatattttttatgagaccatcaaagagagaaagagaataaaaatattttatgagaccatcaaagagagaaagagaataaaaatattttttatgagaccatcaaagagagaaagagaataaaaatattttatgagaccatcaaagagagaaagagaataaaaatattttttatgagaccatcaaagagagaaagagaataaaaatatttttgtatgagaccatcagaaagaggtttaatatttttgtgataccctgaaaggaaataggaatagtgtcataatcgtatcacactattgagacagaaaaagaagaagtcgcgagaggtaactttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttccatcagcggattctgagatggatttaatctgaggacatttggtgaatccaaagttcattctcagacctccaccgatgatggagtaataagtggtaggaggatctacatcctcgactgattccacctcgggatctggatctgactcggactctgtaatttccgttacggattggcaaatcttatcatcggtcggtgtttggtcttgctttgtgactttgataataacatcgattcccatatgatgtttgttttcttcttccgtacacgatgaggatgattgctgaagactggcaggcacatgcatgccagtacgatatattgtttcatgattgctattgattgagtactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctacattacccacatgataagagattgtatcagtttcgtagtcttgagtattggtattactatatagtatatagatgtcgacgctagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaagacgggatcgcagtctttatgattcatagtaatagttagttccgacgttgagatggattcgctgagaccggtagtggtcgtccgagtacacgatgtgtcgttaactggatacaggttaatttccacatcgatatagttaaaggtatttctgggtacgggttcgcatttatctgcggaagagacggtgtgagaatatgttccgagaccacacggagaacagatgacgtctccggatactccgtatcctattccacattttgtttgggaaacacatgccttgcatccatgatcgggagagcattcacagattctattgtgagtcgtgttacacgatcgcgtcgacattgttgacagaaacgtgaccttcattcttaccgtcgtccataaatacgttaggtatgtaccacatactgtcgcgaacgatgcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgccatggaaacaggacattatcactccatgataaattatttaatggagtcgatcctctcattgttctttgcgtatctcaatctgtggcgtttgcttcgtttaaataatatatcaaacatggagacgcctgatatgtaggcattcttcattctattaatgtctgctctatagcgctttagttccttatgacgaccggcgatatcatacttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactagcttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatcttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagttgttgtccgtcgtcttatccaacatgcattgaatgataggtatacttaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataatctctatatctatggttgagcaagaccagtagtattggatggaaacattgttatcgatcaaacatttaattacatccttggatagagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgaaatcatttatattcgacttgagttcgttagaggaattcgaatagctggatatcagtagatgcacaatctgagattttacgtatctatgcttactgtatgctcctagcggagttaatccttcgttgtttctacaaagtctctcgactccgcgagagagtaacagtcgaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctaaatttcagtttatgtttgtaccccgtattcatacttaacaaattggtattacataccattaataatgcaagcataaaaaatcgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgttgataaattatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattattacgtgttgtctattatctgtttataggttcactcgacgaactaaactacctatacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccgtttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggccttgtatacataataataagttgtggtagtatgatctccatatttataatttaggactttgtattcagtttttttggaatcataaaaaataaaaaaaagttttactaatttaaaattatttacatttttttcactgtttagtcgcggatatggaattcgatcctgccaaaatcaatacatcatctatagatcatgtaacaatattacaatacatagatgaaccaaatgatataagactaacagtatgcattatcacaaaaataaatccacatttggctaatcaatttcgggcttggaaaaaacgtatcgccggaagggactatatgactaacttatctagagatacaggaatacaacaatcaaaacttactgaaactgtcaaaaaaatagaaacatatatggtctatatatacactacaatttagttattaattggataaccgatgtgattatcaatcaatattaagaaggttggtaaattggtacatagctaataatacctatacacccaataatacaacaaccatttctgagttggatatcatcaaaatactggataaatacgaggacgtgtatagagtaagtaaagaaaaagaatgtgaaatttgctatgaagttgtttactcaaaacgatagatactttggtttattggattcgtgtaatcatatattttgcataacatgcatcaatatatggcatagaacacgaagagaaaccggtgcgtcggataattgtcctatatgtcgtacccgttttagaaacataacaatgagcaagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataatgagcaaatttattagtatcggttacatgaaggactttacgtagagtggtgattccactatctgtggtacgaacggtttcatcttctttgatgccatcacccagatgttctataaacttggtatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattttcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattgacatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctacatctttattgtatctataatcactatttagataatcagccataattactcgagtgcaacatgttagatcgtctatatatgaataagccgtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataatttcaggaacaggatcatctgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaattgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgagtatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctcgttttgttagatgtttgcatcgtgctttaacatcaatggtacaaattttatcctcgctttgtgtatcatattcgtccctactataaaattgtatattcagattatcatgagatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttatcaaatggttgataatatggatcctcatgacaatttccgaagatggaaatgagatatagacatgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataacacacatgtcttaaagtttattaattaattacatgttgttttatatatcgctacgaatttaaacagagaaatcagtttaggaaaaaaaaatatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctctatatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagattaatggtgtgatgttgattaggtcttttacgaatttgatatagaatagcgtttacatattctccataatggtcaatcgccatttgttcgtatgtcataaattctttaattatatgacactgtgtattatttagttcatccttgttcatcattaggaatctatccaatatggcaattatactagaactataggtgcgttgtatacacatattgatgtgtctgtttatacaatccatgctactaccttcgggtaaaattgtagcatcatataccatttctagtactttaggttcattgttatccattgcagaggacgtcatgatcgcatcctaaaaaaatatattatttttatgttattttgttaaaaataatcatcgaatacgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtataatttttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattctaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggtagacgctgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcgcccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttctaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatctcattgtttgttccctggagtatgagagtcggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttatgaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaggataaagtttatacaagtgtagatgataaattctacagaggttaatatagaagcacgtaataaattgacgacgttatgactatctatatatacctttccagtatatgagtaaataactatagaagttagactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctaaagaaaaatgattatcttcttgagacataactcccattttttggtattcacccacacgtttttcgaaaaaattagttttaccttctaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggataccgcatctgttataatagatctaacggtttcttcactcggtggatgcaataaatgtttaaacatcaaacatgcgaagtcgcagtgtagaccctcgtctctactaatcaattcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggatcttttgtacatcgatatcgccgcaatcactacaataattacaagtattattgatagcattgttattagtactatcataattaaattatcgttattatcattttgtaattgtgacatcatactagataaatcgtttgcgagattgttgtgggaagcgggcatggaggatgaattatcgttattattatttaaagcctcccattcggattcacaaatatggcgcgcgttcaacattttatggaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatacgattagtaatgaccattaaaataaaaatattcttcataaccggcaagaaagtgaaaagttcacattgaaactatgtcagtagtatacatcatgaaatgatgatatatatatactctattttggtggaggattatatgatataattcgtggataatcattcttaagacacatttcttcattcgtaaatcttttcacgttaaatgagtgtccatattttgcaatttcttcatatgatggcggtgtacgtggacgaggctgctcctgttcttgttgtagtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatccaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctagctcggtatctactttatctgccgaatacagtgctaggggaaaaattataatatttcctctttcgtattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgatagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgatggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttggtaatgaaattattcacaatatcagtatcttctttatctaccagagattttactaacttgataaccttggctgtctcattcaatagggtagtaatatttgtatgtgtgatattgatatcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggttatgttatatgtaacattgagtaaatccttaagttcataatcatcactgtcatcagttatgtacgatccaaacaatgtttctactggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgtaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtataaaacaacgaaattatactagagttgttaaagttaatattttctatgagctgttccaataaattatttgttgtaactgcgttcaagtcataaatcatcttgatactatccagtaaaccgtttttaagttctggaatattattatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagagaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggtattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctataatcgttaaattttacaaatctataacatgctaaaccttttgacgacaaccattcattaatttctgatatggaatctgtattctcaataccgtatcgttctaaagccagtgctatatctccctgttcgtgagaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatattgtaatattcatcatcgacataacactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctatacgtttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagccgacttgagtttatcaataactacatcagtgtctagatctctagaatatcccaataggtgttccggagaatcagtaaagaacactccacctataggattcttaatatgatacgcagtgctaactggcagacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcattatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccggtgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatcattttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattacatgttttcatattcattaggattattaaatctttaatcttactacgattgtatgcgttgatattgcaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgttttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatacaattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtaataaattttattagaaatgccaaatctataagaaaagtcctcgaattagtttgaagaatatctatatcgccgtaccgtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctcaacacaaactttttcacagagcgatagagtttttgataactcgtttttcttaagaaatataaaactactgtctccagagctcgctctatcttttattttatttaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttggttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatatctacacaggcataaaatgtaggagagttactaggccccactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactaatttattttatcatttttttattcatcatcctctggtggttcgtcgtttctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggaaaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattacctgcatcttattagaatattaacctaactaaaagacataacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattcccgtatatgaagaaaaagtaaatactgaattcattgctaatggatcgttctctggtagatacgtatcatatcttcgaaagttttctgcccttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacatgatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtaactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtaactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaatcttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacagcaatttctttattctctacagatgtaagatacttgaagacattcctatgatgatgcagaattttggataacacggtattgatggtatctgttaccataattcctttgatggctgatagtgtcagagcacaagatttccaatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctacaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttaacaaaactagactttacaagatctacaggaatgcgtaattcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttaggcgtcggaaaggatgattcatcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatctggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtttgtgattcgtgttaaaaccatcggagaaggaataaaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggcggtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaagaatttatttctaaatctatgagagatcaacgaaaaggaagagtaggaagagttaatcctgggacatacgtatatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtatctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcactgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaatactttcaatgagataaatatgggtggcagagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtaccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatttcacaactttactgtttttaaactgttcaaaatatagcatcgatccatgagaaatacgtttagccgcctttaatagaggaaatcccaccgcctttctggatctcaccaacgacgatagttctgaccagcaacttatttcttcatcatccacctgttttaacatataataggcaggagatagatatccgtcattgcaatattccttttcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgagaatatcacaggggcaatgtttaccacaatgtataatataagaaacaatttgggtctaggagatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcattgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaatcagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctaccgtcctaatataccattaaaaattgttagatttttccgcaataacatggtaactggagtagagatagccgatagatctgttatttcagtcgctgattaatcaattagtagagatgagataagaacattataataatcaataatatattttatatcttatatcttgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattattttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaattatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacacttccagtatcaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgtcaactctcaaaatgctgatttcgacggagatgaagaatggatgatattggagcaaaatcctaaagccgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataggtatgtagtagatataatagtcaatagattatacatcaagagagcagaaattaccgaattagtcgtcgaatatatgattgaacgattcatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggcaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttactcttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcattgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcgatttctatttttagatgtgatggaaaaatgactaattttgtagcattagtatcatgaactctaatcgagatcttaatatcttcgtcacacgttagttctttgaagtttttaagagatgcatcagttggttcgaccgatggagtaggtgcaacaattttttgttcgatgtatgtatgtactggagccattgtcttaactataatggtgcttgtatcgaaaaactttaatgcagataatggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatttcatataagaaactataaagtccgcactactgttaagaatgattactaacgcaactatatagtttaaattaagcatcttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtatgatgactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgagataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaaacacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttattacacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcgcctataaaaacctttatgttgcctaaacaagatatagtaggtttggatctggaaaatctatatgccgtaactaagactgacggaattcctataactatcagagttacatcaaaagggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgcggacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagatcaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctgaagatatgcacactgataaatttgtcatttatgatatttatacgtttgattcgttcaagaataaacgattggtatttgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattctgtcaataagacatcaactacctaaggaatattcaagcgaattactctgtccgaggaaacgaaagactgtagaagctaacatacgagacatgttaatagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtctttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacaaaaaatatcatgttcctattatgaaactatatcctacaccggaagagattccggactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatattaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgaggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagactaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggagccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgttgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggtggatctaatggaatccaattgattaactatcttttgaaaatatacatttttatgatccgatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatacgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcattccaagcgatattatctcaacaaaattcagattctatctttagagtatccactaaactattacggtttatgtactacaatgaactaagagaaatctttagacggttgagaaaaggttctatcaacgatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccaacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgtgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctaaagacaagttaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattggccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaatacccaacttcaccacccttgaatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaatacagactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcttcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatattcaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggcgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagccggtgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccatataccaaactttcagaagaaatggtgtacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatacaatatcttcggtatcttgacgcaatctagtatacatagagttaagagaaattagagtttgtacattaagcaacatgtctctaaatgtggctgcaaacttttccttttccacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttctcaacgtcgatttgatgaacacacgatgaaaatgtacttcgatgagattgatcatgtagaaaacaacaagggatacaatatttccacatatcatgaaatatattaagaaatcccaccttattatatttccccaaaggatccatgcatgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcatacgatccaaattccggaatagatgtatcgcacgctctggccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcatcaacgagttaaaaaagaccagttcattcaagataagcaaacgcgataaggatacgctactaaaatattttacttaggactggagttagaatttatagacgactcatttcgtttatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccattttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatttccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcctgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgccacggttacattcactgcagcattttgaggatcgcgagtatgaagtacgatgttattgtttactggtatatctggaaagaattctaccagtctaggaataagagattgatatcgcatagaaatacaaaagttcataatctcatcatctaagagcattttgttaccattgtaataaatatccactctgtcatatgtataaatgaagtactgttcaaacatgatgagatgtttatatgttggcatagtagtgagatctacgtttggtaatggcaatgtattaagattaactccataatgtctagcagcatctgcgatgttataagcgttgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattctccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgatatcttctatgccaacacaaacaccatccttgggagtagtttatgataaagataaaagaattcagatgttggaggatgaagtggttaatcttagaaatcaacgatctaatacaaaatcatctgataatttagataattttaccagaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtaggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggatttggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatatccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacccgatgaatcggacaatgtactgggccatgtagaataaattatcaacgaattatcgtctacgaacatttatatcatttgttttaattttagtacgcgaataaatagatataaaatagaaaataacagatattacaaccaatgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacggctgcccccatttttaataatcgtcagtatttaaactgttaaatgttggtatatcaacatttaccttatttcccgcagtataaggtttgttgcaggtatactgttcaggaatggttacatttatactttttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtatttgaaacattaacaacgaccgataataaaattactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcagtagatagtttttttgagccatattccacagataatattagacatatgataaaacgattagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattcttctacaaacgattattagattttttcggatcagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggagggtatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatctttattattattgacctcgtttatcttggaacatggaatgggaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgaaattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgagactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcacatagctaaagatttgtcacaatatgaatacactacagttcttctagaacgtcagcctagaaggtcgccgtacgtcaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaaacactaattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcctggacttaatcatgcattttctagtctattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccgttggaaaactttaataacaaagaaagagataggtctaacgcctattcaaaattagaaagtaatggattagttagactgaatgctttcttggaatccggagacgctatagcacgaaatatctcatcaagaactcttgaagatgattttgctagagataatcagattagctttgatgtttccgaaaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatatcgcggatgaaacggaacttccatacgatgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaaaccgtcttttctggtgtaatattctagtttggtagtagatacatatcaatatcatcaaattcgagatccgaattataaaatgggcgtggattgttaactatagaatcggacgtctgatattcgaaaatctgtggagttttaggttttggtggaggtgtaactgctacttgggatactgaagtctgatattcagaaagctgggggatgttctggttcgacatccaccgatggtgtcacatcactaatcggttcggtaacgtctgtggacgatggaggcaccacttctacaggttctggttctttatcctcagtcatcaacggagctacttcaatgcgaggaaatgtataatttggtaatggtttctcatgtggatctgaagaagaggtaagatatctactagaaagataccgatcacgttctagttctcttttgtagaacttaactttttctttctccgcatctagttgatattccaacctcttcacgttcgcatgggttacctccgcagtttttacgagcgatttcacgttcagccttcatgcgtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgatcattaataagatttttatcattgctcgttatttcagaatcgtatatataaggagtaccatcgtgattcttaccagatattatacaaaatactatatataaaatatattgacccacgttagtaatcatgtaaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagccgttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtagctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggaacaatttacaaattgggatcgtctatcgatagactttctctaaataggactattgttacaaaagttaataattataattatgatacattttttgacgatgatgattgatcgctattgcacaattttgtttttttactttctaatatagcgtttagattctttttcatgtgcgaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctggattataaacgggtgtaaacaagaatacatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacagagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttaaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggtcgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattattcgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgatgatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccgcacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaatccaaattcggatctaattaagatagagactccaaacgagttaagttttttaagaagcattagacgcggatattgggtaggagaatccgaaatattaaaccagacaaccccatataattttatagctaaaaatgccacgaagaatggaactaaaaaacggaaatatatttgtagtacaacgaatactcccaaactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttatattttgtagtaagaatagaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcagcatttcctacatatacccggctatgtaccgcgttatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaatatagtctgtgttccataatagtttactttcatgatttcattatcggtgtattttccaaatacatccactagagcagctgtatgaataatcagatttaccccatctagcgcttctcttaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcgggcacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaatgaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaacaagtttatgagcttttataaggataacctagaaaatatagtagatgctatcattactctaaaatatataatgaataatccagattttaaaactacgtatgccgaagtactcggttccagaatagcggatatagatattaaacaagtgatacgtgagaatatactacaattgtctaataatatccgcgaacgatatttgtgaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatatcgcatccgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccaaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaattaaaataacactatttagttggtggtcgccatggatggtgttattgtatactgtctaaacgcgttagtaaaacatggcgaggaaataaatcatataaaaaatgatttcatgattaaaccatgttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcaatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactttatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagttacagacactgtctcatacactacagtaagtacatcatctggaattgtcactactaaatcaaccaccgatgatgcggatctttatgatacgtacaatgataatgatacagtaccatcaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaacatactgagtttttaggaaatatttacggaacttctaaaactgctgtgaatacagcggctattaataatcgtatttgtgtgatggatctaaacatcgacggtgttagaagttttaaaaatacttacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggttgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcacatatcgccacaaaaactactatgctctaagcggaatcgggtacgagagtctagacttgtgtttggaaggagtagggattcatcatcacgtacttgaaacagaaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagtgtgaatcatgtactcatgaaacgtttggaatctatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatgagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaatctattaatgttaaacatacatctgtttcagctaagcaactaagaacacgtatactctcatcttttgccaacacagagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatcaagaagtattctccagatgaataggtgtcacatataaaattttaattaatgtaactatagagaacaaataataggttgtaatatcatatagacaataactaacaattaattagtaactgttatctctttttaactaactaactatacctattaatacatcgtaattatagttcttaacatctattaatcattgattcgcttctttaattttttataaaccaacattgttaattgaaaagggataacatgttacagaatataaattatatatggattttttttaaaaaggaaatacttgactggagtgtatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttatatagatgccgaagacagttacggttgtacattattacatagatgtatatatcactataagaaatcagaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacaatcactacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaagtgcactagtctcgacgtatacggaagtcgtgtacgtaatatcatagcatctattagatatcgtcagagattaattagtctattatccaagaagctggatcctggagataaatggtcgtgttttcctaacgaaataaaatataacgataacgaactgtccacatatctaaaaatcttataaacactattaaaatataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacgtttacatgtgatcagggatatcattcttcggatccaaatgctgtctgcgaaacagataaatggaaatacgaaaatccatgcaaaaaaatgtgcacagtttctgattacatctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtgaatataaatccgttaaaataatgaataattaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggaccaccgactgtaacattaactgaatacgacgaccatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtctccccgctataaaggcattatcaacttctccttattgattgaaaatgaaaatataaatagtttttatgtatagcagtattaccctatagttttattgcttactactaacatggatacagatacagatgttacaaatgtagaagatatcatgaatgaaatagatagagagaaagaagaaatactaaaaaatgtagaaattgaaaataataaaaacattaacaagaatcatcccaatgaatatattagagaagcactcgttattaatacaagtagtaatagtgattccattgataaagaagttatagaatgtatcagtcacgatgtaggaatatagatcatatctactaatttttataatcaatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaatttgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtagactgtttatacaagattgaaatattctttttttatagagtgtggtagtgttacggatatctaatattaatattagactatctctatcgcgctacacgaccaatatcgattactatggatatcttctatgaaaggagagaatgtattcatttctccagcgtcaatctcgtcagtattgacaatactgtattatggagctaatggatccactgctgaacagctatcaaaatatgtagaaaaggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaacaattgtctcctagcaattagtgccgtatactttaaagcaaaatggttgacgccattcgaaaaggaatttaccagtgattatcccttttacgtatcaccaacggaaatggtagacgtaagtatgatgtctatgtacggcgagctatttaatcacgcatctgtaaaagaatcattcggtaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaatttttttcgttggtagatattgctctccgacaactaattgttaaccattttttttaaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtgtagaaatcatccgttgttatataccggatgagcaaaaaaccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctccctttcccagaaacaaactttttttacccactataaaataaaatgagtatactacctgttatatttctttctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcgggcatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagaaggtgttgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttaatatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatatagatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacaatagacacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataatgaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaaaaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagtggaagatacaactgttacgttcattacgacgacgttagaatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctataacgcgactatctaggtatttgtatctcaccgatagagaacatataaatgtagactctattaaacagttgtgtaaaatatcagatcctaatagatgtggatgtacggctttagaaatgagttcattaaaatatgtgatatcaacggaacatatttatataattatactattgctgttagtataattattgattccacggaagaactaccaacagttactccaattacaacaacatataattatactatcgatgatagcactactgaagaactacaagtgactcctcatatggatctccatcgatgatacatgtattaaaatactttccgaataagtcttttaaatattgtattaattatgaaaaactatgctatgcgagtatgatacgatactagattttatctctagcgagagatgtcgttagaatcatttatcaacgaatatcgataacatgtgtcatttatacgttaaagtctgtccgtcttctctattgtttagactgtttgtagaatgctgtgatataaacaaactagtagacacaaatatttaactcatgatgaagttgagaatgatatgctttagctaatataaaaatatattaatccactatatattctagacttgatttaaaaccgataaactactactacgtactgtataagttaggagcagaccctaattatgtagatgatagaggtaatacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtggagatcattaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttcgactgttactctctcgcggagtcgagagactttgtagaaacaacgaaggattaactccgctaggagcatacagtaagcatagatacgtaaaatctcagattgtgcatctactgatatccagctattcgaattcctctaacgaactcaagtcgaatataaatgatttcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctctatccaaggatgtaattaaatgtttgatcgataacaatgtttccatccaatactactggtcttgctcaaccatagatatagagattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtaagtatacctatcattcaatgcatgttggataagacgacggacaacaactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaagatgtatttgatatactaagcaagtacatggatgatatagatatgatcgataactctactatattacgcggtcgatgtcaataatatacaatttgcaaagcggttattggaatatggagcgagtgtcacgctcgataatcaatacggccatccagaaaagcagttaccaaagagaagctagttgatttattactgagttaccatcccactctagagactatgattgacgcatttaatagagatatacgctatctatatcctgaaccattattcgcctgtatcagatacgccttaatcctagatgatgattttccttctaaagtaagtatgatatcgccggtcgtcataaggaactaaagcgctatagagcagacattaatagaatgaagaatgcctacatatcaggcgtctccatgtttgatatattatttaaacgaagcaaacgccacagattgagatacgcaaagaacaatgagaggatcgactccattaaataatttatcatggagtgataatgtcctgtttccatggcatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgcatcgttcgcgacagtatgtggtacatacctaacgtatttatggacgacggtaagaatgaaggtcacgtttctgtcaacaatgtcgacgcgatcgtgtaacacgactcacaatagaatctgtgaatgctctcccgatcatggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacctttaactatatcgatgtggaaattaacctgtatccagttaacgacacatcgtgtactcggacgaccactaccggtctcagcgaatccatctcaacgtcggaactaactattactatgaatcataaagactgcgatcccgtcttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagcgtcgacatctatatactatatagtaataccaatactcaagactacgaaactgatacaatctcttatcatgtgggtaatgtagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtactcaatcaatagcaatcatgaaacaatatatcgtactggcatgcatgtgcctgccagtcttcagcaatcatcctcatcgtgtacggaagaagaaaacaaacatcatatgggaatcgatgttattatcaaagtcacaaagcaagaccaaacaccgaccgatgataagatttgccaatccgtaacggaaattacagagtccgagtcagatccagatcccgaggtggaatcagtcgaggatgtagatcctcctaccacttattactccatcatcggtggaggtctgagaatgaactttggattcaccaaatgtcctcagattaaatccatctcagaatccgctgatggaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaagttacctctcgcgacttcttctttttctgtctcaatagtgtgatacgattatgacactattcctatttcctttcagggtatcacaaaaatattaaacctctttctgatggtctcatacaaaaatatttttattctctttctctctttgatggtctcataaaaaatatttttattctctttctctctttgatggtctcataaaatatttttattctctttctctctttgatggtctcataaaaaatatttttattctctttctctctttgatggtctcataaaatatttttattctctttctctctttgatggtctcataaaaaatatttttattctctttctctctttgatggtctcataaaaaatattaaacctctttctgatggtgtcactaaaatatttttattctctttctctcttcaatggagtcataaaatatttttattctctttctctcttcgatggtctcacaaaaatattaaacctctttctgatggtgtcactaaaatatttttattctctttctctcttcaatggagtcataaaatatttttattctctttctctctttgatggtctcacaaaaatatttttattctctttctctctttgatggtctcacaaaaatatttttattctctttctctctttgatggtctcacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctctttgatggtctcataaaaaaagttttacaaaaatatttttattctctttctctctttgatggtctcataaaaaatattaaacctctttctgatggtgtcactaaaatatttttattctctttctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcactaaaatattttttattctctttctgatgcatcaactatttcttaaacaataacgtccaacaacatatactcgtcgagcttatcaacatcccctatgcccatctaggttaccagacaattgtatatcataaaataatgtttataatttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctctttctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctctttctctcttcaatggagtcataaaatatttttattctctttctctcttcgatggtctcacaaaaatattaaacctctttctgatggtgtcactaaaatatttttattctctttctctcttcaatggagtcataaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattttctctttctctcttcaatggagtcataaaatatttttattctctttctctctttgatggtctcataaaaaatattaaacctctttctgatggtgtcactaaaatatttttattctcattctctcttcaatggagtcataaaaaagttttatctctttctctcttcgatggtctcacaaaaatattaaacctctttctgatggagtcgtaaaaaagttttatctctttctctcttcgatggtctcacaaaaatattaaacctctttctgatgcatcaactatttcttaaacaataacgtccaacaacatatactcatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagactaactatctctttctctttctctcttcgatggtctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggtgtcactaaaatatttttattctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggtctctataaagcgattgatttttcttaccctctagagtttcctacggtcgttggtcacacatttttttctagacactaaataaata

SEQ ID NO: 2 - DNA, 194711 bp, Vaccinia virus
atttaaaatataatattaatgtactaaaacttatatattattaatttatctaactaaagttagtaaattatatatataattttataattaatttaattttactaattttatttagtgtctagaaaaaaatgtgtgacccatgactgtaggaaactctagagtgtaagaaagatcgatcgctttatagagaccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagaaagagatagttgatctagatatttttcttagtacaaaagtcaatgttttaaaatatatggacaagaatttgtctgtataaaaacttgtgtgaaattttgtaccaaagaaaaaatgtgagcagtatcccctacatggattttactagatcatttatataccaaaaaatattatacgatctacgttttattatatgattttaacgtgtaaattataaacattattttatgatatacaattgtctggtaacctagatgggcataggggatgttgataagctcgacgagtatatgttgttggacgttattgtttaagaaatagttgatgcatcagaaagagaataaaaaatattttagtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgataccctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttaaatccatccttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttgatcatagccagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcacatgcatgccaggacgatatattgtttcatgattgctattgattgagtactgttctttatgattctacttccttaccgtgcaataaattagaatatattttctacttttacgagaaattaattattgtatttattatttatgggtgaaaaacttactataaaaagcgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgacgctagatagacagtctccgaatgcggcatgataccgtcatcattctttgctttcgttaactgtttggaggaaaaatttttgttattgcatttaatctcgaaattcagagtgcacacctttctcctgtaaagaaacctgaagttgctaccttattaaggacggagaagtattcctcacgaaatacgggattacagtctttatgattcatagtaatagttagttccgacgttgagatggattcgctgagaccggtagtggtcgttaactggatacagattaatttccacatcgatatagttaaaggtattactgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacggtcgcgtcttccgttacaacttagacaagcgggtaaatgattattgcgagatgtgaaggtacccgaaccacacggcgtacattgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgtcgtcttgttcctgtttcctacttctccaatcatatagatattttctttctatcatggataatatttgtaatggttcttttcgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctattatcttctttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgcttttgtagaacgtggatatgtgtttacagtagtaatgaagagaagtgagttcatcctcgtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtgtcctttttcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtgaaatacatatgacagacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaacagaacaatatatttttttagtaatgtttatgcgagacatataaaataaactccgtgtttatgatcatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgtcgatgaaatatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattacgtgttgtctattatctgtttataggttcactcgacgaactaaactacctatacaagatatggttgtgccataatttttataaatttttttatgagtatttttacaaaaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggctgagtatgcataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattaataacattacatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaatgtggttattgattggataaccgatgtgattgttcaatcaatattaagagggttggtaaattggtacatagctaataatacctatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtactcatatattttgcataacatgcatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatattatcatgaataaaaatagtagcacgcactacttcagccaaatattcttttttgaaacgccatctatcgtagtgaggacacaagtgaacctataattatcaaatttattagtatcagtcacatgaaggactttctgtagagtgacgattctaccatctatggtactaacggtttcatcctccttgataccctcacccaaatgttctataaatttagcatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaagcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgtcggaaataatatcatatgcttccacatatattttattttgttttaactcataatactcacgtaattctggattattggcatatctatgaataattttagctccatgatcagtaaatattaatgagaacatagtattaccacctaccattatttttttcatttcgttcaattcttgattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacacaatctaatgtaggtttatgacataatagcattttcagcagttcaatgtttctagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtattcgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctaaatctacatctttattgtatctataatcactatttagataatcagccataattactcgagtgcaacatgttagatcgtctatatatgaataagcagtgttatctattcctttcattaacaatttaacgatgtctatatctatatgagatgacttaatataatattgaagagctgtacaatagtttttatctatagaagacggcttgattccgtgattaattagacatttaacaacttccggacgcacatatgctctcgtatccgactttgaatacagatgagagatgatatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccagatagtcaaacattttgactgaatgagctactgtgaactctatacacccacacaactaatgtcattaaatattatttttttgaatgtatttataccatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctcttttttgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttctctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtctagatctatagaatcaaaacacgataggtcagaagataatgaatatctgtacgcttctttttgtactgtaacttctggttttgttagatggttgcatcgtgctttaacatcaatggtacaaattttatcctcgctttgtgtatcatattcgtctctagtataaaattctatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttattaaatggttgataatatggatcctcatgacaatttccgaagatggaaatgagatatagacatgcaataaatctaatcgaagacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaactaacgaatatcaacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaatcagtttaggaagaaaaaaattatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagcgatagtttgtagagatcttataaaaccgtcaaacgacatcgcatttatatctttagctaattcatatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctttatcgcattagtaagttcagaatatgttataaatttaaatcgaataacgaacatgactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatagattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaaatgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtataattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttttcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgtttcaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgttttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtggaattaatattatgaatcatagtttttacacatagatctactacaggcggaacatcaattattatggcagcaactagtatcatttctacattgtttatggtgatgtttatcttcttccagcgtatatagtctaatagcgattcaaacgcgtgatagtttataccattcaatataatcgcttcatcctttagatggtgatcctgaattcgtttaaaaaaattatacggagatgccgtaataatttccttattcacttgtataatttccccattgatagaaaatatcacgctttccattcttgaagtactataagtaattatagtataatgtaaaggtttatatattcaatattttttataaaaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattaaaatattattagggtcagtactcattatcattcggcagctattacttattttatttttctgtattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagtaatttaactattttagttaacaactattttttatgttaaatcaattagtacaccgctatgtttaatacttattcatattttagtttttaggattgagaatcaatacaaaaaattaatgcatcattaattttagaaatacttagtttccacgtagttaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttattcttttaaacagatcaatggtgtgatgttgattaggtcttttacgaatttgatatagaatagcgttcacatatcctccataatggtcaatcgccatttgttcgtatgtcataaattctttaattatatgacactgtgtattatttagttcatccttgttcatcattaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcctaaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacaaagtctacactaaaatgattgaacaatagatagtctaccattgtttcgtattcagatagtacagcgtagtacatagcatcttcacaaattatatcattgtctaatagatatttgacgcatcttatggatcccacttcaacagccatcttaaaatcggtagaatcatattgctttcctttatcattaataatttctaaaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgctatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagtaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcaaagtgaggatagtcaaaaagataaatatatagagcataatccttctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtctacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatatacgccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaactgacacttgtctgtctatagcggctcttcttaattcatcttctatataaggccaaaacaaaatattgcctgccttcgaataaataatagggataaagttcataacagatacataaacgaatttactcgcatttctgatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatcttgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttagtgtgatggttcccataagtttggcagctagcagattcagttttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaataatcatcgcatatagtatgcgatagtagagtaaacatttttatcgtttctactgggttcatacatcgtctacccaattcggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccgcctcctatatcaatgccttttagggacagaccagacctaggagctattctaccatagcagaacttaggcatggacatactaatatctgtcttaattaactgtcgttctcctggagggatagtataatcgtaagcgctatataaatcatatccggcggcgtaaggtgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttaccgctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctaaagaaaaatgattatcttcttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggataccgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaataacaataaattttttttcagttatctatatgcctgtacttggatcttttgtacatcgatatcgccgcaatcactacaataattacaagtattattgatagcattgttattagtactatcataattaaattatcgacattcatgggtgctgaataatcgttattatcatcattatcattttgtaattgtgacatcatactagataaatcgtttgcgagattgttgtgggaagcgggcatggaggatgaattatcgttattattatttaacgcctcccattcggattcacaaatgttacgcacattcaacattttatggaaactataattttgtgaaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagttgtaacgatgactccatcttttagatgcgatactcctttgtatgtaccagaatcttcgtaccgcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatacgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcattcttaagacacatttcttcattcgtaaatcttttcacgttaaatgagtgtccatattttgcaatttcttcatatgatggcggtgtacgtggacgaagctgctcctgttcttgttgtagtcgccgactgtcgtgtttgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcttcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttctaatgctgtactaaattcgatatctttttcgatttctggatatgtttttaataaagtatgaacaaagaaatggaaatcgtaataccagttatgttcaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatatttcctctttcgtattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatgttgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaatttctttggtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcagttaacatgcaggaattatagtaagccaattccaattgttgcctgtattgtattagagtattaatatgcgcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctactggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtaactgcgttcaagtcataaatcatcttgatactatccagtaaaccgtgtttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtgactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctataatcgttaaattttacaaatctataacatgctaaaccttttgacgacagccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccacggccttcttcatttcgtgccaaaataatatacagtcttaaataattacgcaatatctcaatagtttcataattgttagctgttttcatcaagatttgtaccctgtttaacatgatggcgttctatacgtctctattttcttttttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagccgacttgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataagcatgtccaatacgttagacaacacaccgacgatggcggccgccacagacacgaatatgactagaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagcccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattagaattaattatcgatagtaatgcatcgacgcttccaaaattgtctattataaactcaccgataatttttttattgcatgttttcatattcattaggattatcaaatctttaatcttactacgattgtatgcgttgatattgcaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatgtatgtaaaaatatagtagaatttcattttgtttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgacaacgtggcgtcgagacttttgaactaaaatacaattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagttctagaattagtctgaagaatatctatatcgccgtaccgtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttttgaatatttctagcttgtaattttaacatatgatattcgttcacactaggtactctgcctaaataggtttctataatctttaatgtaatattaggaagagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatttaattcgatacaaactcctgatactggttcagaaagtaattcattaattttcagtcctttatagaagatatttaatatagataatacaaaattttcagttcttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactaaacattctattttttgtggattagtgtactctcttccctctatcatgttcactactggtgtccacgatgataaatatctagagggaatataatatagtccataggatgccaatctagcaatgtcgaataactgtaatttgattcttcgttcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatgtctacacaggcataaaatgtaggagagttactaggccccactgattcaatacgaaaagaccaatctctcctagtaatttggcagtactcattaataacggtgacagggttagcacctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgctcgtcgatatagattttagacatttttagagagaactaacgcaatcagtaataaaactaatttattttatcattttttttattcatcatcctctggtggttcgtcgtttctatcgaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggttaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataattagtgaaagtcagtgtccgatgatcaatgacgatagctttactctgaaaagaaagtatcaaatcgatagtgcggagtcaacaataaaaatggataagaagaggacaaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacggaatccaagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggaaaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacacaatacaatcgtacaaggaaaccgtgcataaactaacacaagatgaaaaatttttagaggttgccaaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttaagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatcgttctctggtagatacgtatcatatcttcgaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatataaatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgccgagtatttcatcgttgtatatttcttcttcgattgcataatcagattcttatataccgcctcaaactctattttaaaattattaaacaatactctattattaatcagtcgttctaactcctttgctatttctatggacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacatagtcgaacgttagttccaacaattgtttagctattcgtaacaaaactatttcagaacataaaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacaaatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatggagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgctcgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagtgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggctccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcacaaaccaccggtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtacgtagcgtacaaaatgattgttcctggtatatagataaagagtcctatatatttgaaaatcgttacggctcgattaaactttaatgattgcatagtgaatatatcattaggatttaactccttgactatcagggcggcaccagaaattaccatcaaaagcattaatacagttatgcctatcgcagttagaacggttatagcatccaccatttatatctaaaaattagatcaaagaatatgtgacaaagtcctagttgtatattgagaattgacaaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaaaattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccatttttccatacgtttatattcttttaatcctgcgttatccgtttccgttatatccagtgatagatcgtgcaggttaaatagaatgctcttaaataatgtcatttttttatccgctaaaaatttaaagaatgtataaacttttttcaaagatttaaaacttttaggtggtgtcctagtacacaatatcataaacaaactaataaacatcccgcattcagattccaacagctgattaacttccacattaatacagcctattttcgctccaaatgtacattcgaaaaatctgaataaaacatcaatgtcgcaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaaaacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactaactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgaccgagaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtaaagtttttgtccccgctccttttggaggatcgcaagaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttctacatctccttttgtagacacgactaaacattttgcaaaaaaaagtttattagtgtttagataatcgtatacttcatcagtgtagatagtaaatgtgaacaaataaaaggtattcttactcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaattcaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgttcaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactttgcgagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatctgttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaacaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtatgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaatagttcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatcaacatatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattaggtaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaataaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcattttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacaccggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgacgactaaggccactactcaaatagcacctaaacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcactgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctatagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacattgaatataaaataactacagtttgaaaaataacagtatcatttaaacatttaacttgcggggttaatctcacaactttactgtttttgaactgttcaaaatatagcatagatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatatcctaaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgcaatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaatcagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatctcgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtataccttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacacttccagtatcaatttatcatatattacatccggcaaaaataatatgattagaagttatatcgtcgcccgacgaaaagatcagacggctagatctgtaattggtcccagtacatctatcaccgttaatgaggtaggaatgcccgcatatattagaaatacacttacagaaaagatatttgttaatgcctttacagtggataaagttaaacaactattagcatcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggagatgaagaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcctacagaactaatgtatattctaggtacgtatggacaacaaaggattgatggtgaaccagcagagactcgagtattgggtagagtcttaccttactatcttccagactctaaggatccagaaggaagaggttacattcttaattctttaacaaaaggattaacaggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaattaccgaattagtcgtcgaatatatgattgaacgattcatctcctttagcgtcattgtaaaggaatggggtatggaaacattcattgaggacgaggataatattagatttactgtctatctaaatttcgttgaaccagaggaattgaatcttagtaagtttatgatggttcttccgggggcagccaacaagggaaagattagtaaattcaagattcctatctctgattatacgggttatgacgacttcaatcaaacaaaaaagctcaataagatgactgtagaactcatgaatctaaaagaattaggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagtttagatttaacgttaaagatgagcataaacataataaacaaaattacaatcaaacctataacattaatatcaaacaatccaaaaaatgaaatcagtggagtagtaaacgcgtacataactcctggataacgtttagtagctgccgttcctattctagaccaaaaattcggtttcatgttttcgaaacggtgttctgcaacaagtcggggatcgtgttctacatatttggcggcattatccagtatctgcctattgatcttcatttcgttttcaattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaagtctatcaataactggcacaacaataacaggagttttcgccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttcgaccgatggagtaggtgcaacaattttttgttcgatgtatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaaaaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttaattggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataagccgctattgaaactgacggatgattctagtcccgaagaatttctgttcaacaaactaagtgaacgaaaggtatatgaatgtatcaaacagtttggtattagaatcaaggatctccgaacgtatggagtcaattatacgtttttatataatttttggacaaatgtaaagtccatatctcctcttccatcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaaaaccgataaatggaaatggataagcgtatgaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttattacacgctattaatcatccaaagtcaaggcctaatacatctctggaaatagaatttacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagagtcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccatctacaagaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttttaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtagataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatatacacttttgacgctttcaagaataaacgattggtattcgtacaggtacctccgtcgttaggagatgatagtcatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtagagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacacccgaagagattcctgactttgcattctatctcaaaataggtactctgttagtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatatcaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttctactattgtctggatctcccattactaacacacctaatactctgggtcatattatagatttaatgtccgaagagacgatagattttggtgagattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtaacgtcattaaacgattacacacaggatgaattgattaatgttttaccatttgacatcaaaaagctgttatatctaaaatttaagactaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgaaatatataaagaaataaatgtcgagctttgttaccaatggataccttccagttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcacgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaattcggaaatgtaattctaaaacttacaacgcgcgataaattatttaataaagtatatataggttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactgctgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatatttttgttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattgattgagaagaagctaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctcccaatagttctccccttttaaaggtatctaatgcagatttagaaaattctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttttcatcaactagacgtttattctcaaatagcgattggtgttgtaaggatcctggtcgtagtaagttaaccaacatggtgaattcttgcacactattgacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatcttttaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtggaccatcgctaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaatgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcaaaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcgtcgatggaaaccatacaatcctttttgataggctgttgagattgattatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatatttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggaacagtactactaggtagaagaataggagccggtgtagctgttggaaccggctgtggagttatatgaatagttggttgtagcggttggataggctgtctgctggcgaccgtcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattttttcttgttatccgatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacataatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcatatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaagataatagggagaaatgacattttggattctgttacgactttaccaaaattaaggatatacggacttactatctttttctcaacgtcgatttgatgaacacacgatgaaaatgtgcttctatgagattgatcatgtagaaaacaacaagggatacaatatttccgcatatcatgaaatatattaagaaatcccaccttattatatttccccaaaggatccatgcatgtaaacattatgccgttatcattaataaagacttctttctcatcggatttgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcatacgatccaaattccggaatagatgtatcacatgctcttgccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattttttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcttttgtttagaacgattagctacagagttcaacgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaatcaatttttctgcctcgtttttactacaactagttttcatcaatgtagcgacgatgtattgtttagttactcttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctgggtaacaaacatactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacttttcgtagagagttattgatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttggaggatgaagtggttaatcttagaaatcaacgatctaatacaaaatcatctgataatttagataattttaccaaaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacaaaaaattatcgtcactaacgtgattattattgtcataaacattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtaggcatctttttagatggtttctttttcccagcattaactgagtcgatacctagaagatcgtgattgatctctccgaccattccacgaacttctaattggccgtctctaacggtaccataaactattttaccagcattagtaacagcttggacaatctgaccatccatcgcattgtacgatgtagtagtaactgttgttctacgtctaggagcaccagaagtatttttggagcccttggaggctgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatacagaagatttaactagattatacaatgaactaatatgatccttttccagattatttacaaacttggtattttttggttctggaggaggcgaatttaaattcggacttggattcggattttgtgagttcttgatcttattatacatcgagtataggatggcgacggtaactgctacacaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatagatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtatttgaaacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccagctaaccgaatttattgtaacagtattattaatattgccaagttatccgatctaaaaaaaactatctatgcggtagatagtttttttgagccatattccacagacaatattagacatatggtaaaacgactagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattattctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaagaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctataacacgatcgtgcaaaacctggtatatcgtctctatctttatcacaatatagtgtatcgacatctttattattattgacctcgtttatcttggaacatggaatgggaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgaaattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctcttttgatgataaatttccaaaaatatccatatcgtatattaagttgggagaacttaggcggcaagttgtagactttttcaaattctcgttcatgtatattgagtccatcaaggtagatcgtataggagataatatttttattcctagcgttataacaaaatcaggaaaaaagatattagtaaaagatgtagaccatttaatacgatctaaggttagagaacatacatttgtaaaagtaaaaaagaaaaacacattttccattttatacgactatgatgggaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcagattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtatataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtacttacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgatgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtggcatcttcattagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccgttggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagataaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggcgcagccaatactattacagaagttttaaaagactcagaagaggattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagttttaggttttggtggaggtgtaactgctacttgggatactgaagtctgatattcagaaagctgggggatgttctggttcgacatccaccgatggtgtcacatcactaatcggttcggtaacgtctgtggatggaggtgctacttctacagaacctgtagcctcagttgtcaacggagatacatttttaatgcgaggaaatgtataatttggtaatggtttctcatgtggatctgaagaagaggtaagatatctactagaaagataccgatcacgttctagttctcttttgtagaacttaactttttctttctcagcatctagttgatattccaacctcttcacgttactacgttcagattccaattcacgttcgcatgggttacctccgcagtttttacgagcgatttcacgttcagccttcatgcgtctctccttctctctatcgagtttatcagagcagtctttctgaaggcgatcgaactccataaatttctccaacgctttgattgtttccatagatttccgaagttcagcttttaggactgtgattctttttctttcgaattcacagctggatgtgcaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacacaatctcttgcttcttcgtcatagtacttacaatcactatgggatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctgattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtctacagtcgttcaactgtctttcaagatctgatattctagattggagtctgctaatctctgtagcattttcacggcattcactcagttgtctttcaagatctgagattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacgtctgaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaagaggaaatattcagtatatagatatgccttagcatcatatcttgtactaaacacgctaaacagtttattgatgtgatcaatttccaacagaataattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttttacctcagtggcgaaatctttggagtgcttggtacatttttcaataaggttcgtgacctccatttattataaaaaattttattcaaaacttaactacaatcgggtaattataaaatcgtagatctcccatgtggtggaatactaccatctatcgcatgtggatggacagtaggtaatggccatgggaacagtaatgtttgcatatttatctttcttgccagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcgaaaacagaatatcctaaaccatataatatatattcagggacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgctcattaataaaatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatgggcgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttttactttctaatatagcgtttagattctttttcatgtgcgaatattgatttactaaaatatcgatgtttaacttttgttctatgacgtccttatcagcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcacctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacggagacaaaattcaaggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgttgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgtcatggcgcctagcacagaacacatttacgatagtgttgctggaagcacgctgctaataaataatgatcgtaatgaacagactatttatcagaacactacagtagtaattaatgagacggagactgttgaagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattccccatagactatcgactattatactctgtattagttctgtcggaggatgtgttatctctatagataatgacatcaatgacaaaaatattctaacatttcccattgatcatgctgtaatcatatccccactgagtaaatgtgtcgtagttagcaagggtcctacaaccatattggttgttaaagcggatatacccagcaaacgattggtaacatcgtttacaaacgacatactgtatgtaaacaatctgtcactgattaattatttgccgttgtctgtattcattattagacgagtcaccgactatttggatagacacatatgcgatcagatatttgcgaataataagtggtattccattataaccatcgacgataagcaatatcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtatacgtacctggtaagatatctttatattctataatcaatgagacatcactatccgataacgaatgaagtctagcactagtatgccatttacttaatatggtcgtcttggaagttttattataagttaaaatatcatggttgtccaatttccatctaatatactttgtcggattatctatagtacacggaataatgatggtattattacatgctgtatactctatagtctttgtagatgttataatcataaaagtacagaggtatatcaacgatattctaactcttgacattttttatttatttaaaatgatacctttgttatttattttattctattttgctaacggtatcgaatggcataagtttgaaacgagtgaagaaataatttctacttacttattagacgacgtattatacacgggtgttaatggggcggtatacacattttcaaataataaactaaacaaaactggtttagctaatactaattatatcacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccgcattatgtacctattctatgaataccattaaacaatctttttctacgtcaaaattggaaggatatacaaagcaattgccgtctccagctcctggtatatgtctaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaatccaaattcggatctaattaagatagagactccaaacgagttaagttttttaagaagcattagacgcggatattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacattagaaggaggaacagttttaaagtctcttggttttaatctattaccgttagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaatagatcaacagaaatatttaatcctccgtttgatacagatgcaccatatttatggattttggattcacacgttgtttgtctgaggggttcgtctagcgttgcttctacataaacttctattcccatatattctttattgtcagaatcgcataccgatttatcatcatacactgtttgaaaactaaatggtatacacatcaaaataacaaatactaacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgcgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatggcatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaattctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcaacatttcctacatatacccggctatgcaccgcgtcatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttatttggtcctattgcttccatgctactagtatagatcaaatacttgattcctaggtccacacaagctgccaatatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaatgaaggagtctcatagatgtatagaggtcagatactggtttgataaactgtttattccacatgagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattattttatatatccctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgacctatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcgttctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagaccgaattgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtgagaatatactacaattgtctaatgatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagacgtggatagtttcttaactacgttatcatccgtaactaaagaatcgcatcaaataaaattattgactgatatcgcatccgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaagggttttgcaagaccaattaacgatggttaaaattaacaaggatcccaaaaaaattccagagtggttggtagttaataaaatctatattcccgattttgtagtagaggatccgaaacaatctcagatatgggaaatttcaggagcagagtttacatcttccaagtcccataccgcaaatggaatatccattagatttcctagatttactaggattagagaagataaaacgtggaaagaatctactcatctaaacgatttagtaaacttgactaaatcttaatagttacatacaaactgaaaattaaaataacactatttagttggtggtcgccatggatggtgttattgtatactgtctaaacgcgttagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgttattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcagcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcaaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagctattaaactgtttattaatgatcacatgcttgataagataaaatctatactgcagaatagactagtatatgtggaaatgtcatagaaagttaaaagttaatgagagcaaaaatatataaggttgtattccatatttgttattttttctgtaatagttagaaaaatacattcgatggtctatctaccagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctactccgccaccaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccacaatcccaattattctaatggatgtcatcaatgtagaaaatgcccaaccggatcatttgataaggtaaagtgtaccggaacacagaacagtaaatgttcgtgtcttcctggttggtattgtgctactgattcttcacagactgaagattgttgaaattgtgtaccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattagtatagttattaatgatgaaaggataaacgctcataaactcatcctatctggagcctccgaatatttttccattctgttttccaataattttatcgattctaatgaatacgaagttaatctaagtcatttagattatcaaagcgttaacgatttgatcgattacatttatgggatacctttgagcctaactaacgataacgtgaaatatattctttcaaccgctgattttttacaaattggatctgctattacggagtgtgaaaattacatacttaaaaatctttgttctaaaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggattttgcaccactaattctcattaaatggttagagagtactcaacaatcatgcaccgtcgagttacttagatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgataaatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataatccgatatatgatgaatggaccaaattatcatcattaaacattcctagaattaatcccgctctatggtcagcgcataataaattatatgtaggaggaggaatatctgatgatgttcgaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctaagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagatcatacagttacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaattttctgtattacatattatatatataataaacgttcacgtaaatacaaaacagagaacaaagtctagatttttgacttacataaatgtctgggatagtaaaatctatcatattgagcggaccatctggtttaggaaagacagccatagccaaaagactatgggaatatatttggatttgtggtgtcccataccactagatttcctcgtcctatggaacgagaaggtgttgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgacggtgttagaagtcttaaaaatacgtacctaatgccttactcggtgtatataagacctacctctcttaaaatggttgagaccaagcttcgttgtagaaacactgaagctaacgatgagattcatcgtcgcgtgatattggcaaaaacggatatggatgaggccaacgaagcaggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggagaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattatgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgaatgcacttagtccaggacctatcattgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaataatgtactcatgaaacgtttggaaactatacgccatatgtggtctgtcgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtgaatcagtcaaatttggtaattctattaatgttaaacatacatctgtttcagctaagcaactaagaacacgtatacggcagcagcttcctttatactctcatcttttaccaacacaaagggtggatatttgttcattggagttgataataatacacacaaagtaattggattcacggtgggtcatgactacctcagactggtagagaatgatatagaaaagcatatcaaaagacttcgtgttgtgcatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaatagattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaaaatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacactattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaatgataaacagaaagttacgtttacatgtgatcagggatatcattcttcggatccaaatgctgtctgcgaaacagataaatggaaatacgaaaatccatgcaaaaaaatgtgcacagtttctgattacatctctgaattatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaatggattaatttccggatctacattttctatcggtggcgttatacatcttagttgtaaaagtggttttacactaacggggtctccatcatccacatgtatcgacggtaaatggaatcccgtactcccaatatgtgtacgaactaacgaagaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataatgaataattaataacgaacaagtatcaaaagattaaagaattatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacaatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatccaagtggatatattagagaagcactcgttattaataccagtagtaatagtgattccattgataaagaagttatagaatgtatctgtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaatttgggaagagtattcgccccaaaggatactgaatcagtcttcgaagcatgcgtcactatgataaacacgttagagtttatacactctcaaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatttaatattagactatctctatcgcgctacacgaccaatatcgattactatggatatcttcagggaaatcgcatcttctatgaaaggagagaatgtattcatttctccagcgtcaatctcgtcagtattgacaatactgtattatggagctaatggatccactgctgaacagctatcaaaatatgtagaaaaggaggagaacatggataaggttagcgctcaaaatatctcattcaaatccataaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctgatacctgtctcctagcaattagtgccgtatactttaaagcaaaatggttgacgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggctcgtataatctggtggatactctagtaaagtcaggactgacagaggtgttcggttcaactggagattatagcaatatgtgtaattcagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaattcttttcgttggtagatattgctctccgacaactaattgttaaccattttttttaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcagacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtgcagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctcaattacgtggattataacatcatattccggcgtatgaattgatgagttgtacatcttgacattttcttctttcttctcttctccctttcccagaaacaaactttttttacccactataaaataaaatgagtatactacctgttatatttctttctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcgggcatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagatggcattgtaacttcaataggtagtaatttgactattgcatgcagagtatcgttgagacctcccacaacggatgcagacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagtaaaacagttactgttagtataacgtgaatgtatgttgttacatttccatgtcaattgagtttataagaatttttatacattatcttccaacaagcaattgacgaacgtattgctatgattaactcccacgatactatgcatattattaatcattaacttgcagactatacctagagctattttgacatactcgtgttcttgtgtaattgcagtatctatattattaaagtacgtaaatctagctatagttttattatttaattttagataatataccgtctccttatttttaaaaattgccacatcctttattaaatcatgaatgggaatttctatgtcatagttaatatattgtgaacaacaagagcagatatctataggaaagggtggaatgcgatacattgatctatgtagttttaaaacacacgcaaactttgaagaatttatataaatcattccatcgatacatccttctatgttgagatgtatatatccaggaattcgtttattaatatcgggaaatgtataaactaaaacattgcccggaagcggagcttctaccggagttatatcagtttttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggaatctaacgcacatcgtcgtacgtttatacaattgtgatttagtgtagtatatctacacatgtatttttccgcgctatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgcaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcgaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtcctgcagattcgataacttatttgatgaataggtttaaaaatatagatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacaatagacacgttaggaatcgcgattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaccgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggaaaggctagaaaaaaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattagaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtattaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaataattattattattatttatatcgtatttgtgctataacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattatttatctagcgattatgaaaattataatgaatattattatgatgattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaatgatgtatctacacaaacatgggaaaagaaatcagagttagatagatacatggaaatgtatcctcgtcatagatatagtaagcattctgtctttaagggattttctgacaaagttagaaaaaatgatttagacatgaatgtggtaaaagaattactttctaacggtgcatctctaacaattaaggatagcagtaataaggatccaataaccgtttattttcgaagaacgataatgaatttagaaatgattgatgaacgaaagtatatagtacactcctatctaaaaaattataaaaatttcgattatccatttttcaggaagttagttttgactaataaacattgtctcaacaattattataatataagcgacagcaaatatggaacaccgctacatatattggcgtctaataaaaaattaataactcctaattacatgaagttattagtgtataacggaaatgatataaacgcacgaggtgaagatacacaaatgcgaactccattacacaaatatttgtgtaaatttgtatatcataatattgaatatggtatccgatactataatgaaaagattatagacgcatttatagagttaggagccgatctaactattccaaatgacgatggaatgataccagtagtttactgtatacactcaaatgccgaatatggttataacaatattactaacataaagataatacgtaaactacttaatcttagtagacgtgcgtcacataatctatttagagatcgagtcatgcacgattatataagtaatacatatattgatcttgagtgtttagatattattagatcgttggatggattcgatatcaatggttactttgaaggacgtacaccacttcattgcgctatacaacataacttcactcagattgctaagtacttattagatcgaggagctgatatagtcgtacccaacacattgattatacatcagtacatacagtaaatagcatagatatggaggaggatacaaatatttcaaataaagttataaggtacaacactgtcaataatatatgggaaacattacctaacttctggactggaactataaatccaggcgtggtctcgcataaagatgatatatatgttgtatgcgacatcaaagatgaaaaaaatgttaaaacttgtatatttagatataacacgaatacgtataacggatgggaattggtcacgacgacagaaagcagattatcagctctgcatactattctttataacaataccataatgatgttacattgttatgaatcgtatatgttacaagatacatttaatgtgtacactcgcgaatggaatcatatgtgtcatcaacattcgaatagttatatcatgtacaatatactacccatctactaaatataatagaataaaataaatgagtatgatcattttagataacgattgattttatcattaccgcttcattcttatattctttgcttacggaacctatatttagaaacatctactaacgattttttatgcttgcattattaatggtatgtaatatgattgattgtgtacgcaataccaatttgttaagtatgaatacggggtacaaacataaactgaagtttaacattatttatttatgatatatatcgttattgtttggtctataccatggatatctttaaagaactaatcttaaaacacacggatgaaaatgttttgatttctccagtttctattttatctactttatctattctaaatcatggagcagctggttctacagctgaacaactatcaaaatatatagagaatatgaatgagaatacacccgatgacaataatgacatggacgtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagtgttgatatgatggtgagcactgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtaatagtataaactaaagctgataatacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccatttcggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattctttttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcaagattatattagaatcaaattaatctttcatacgagaaaaataacgacatacgtcgtcaacaaattaaactttttatttattagttaactagcttatagaacttgctcattgttatgtttctaaaacgggtacgacatataggacaattatccgacgcaccggtttctcttcgtgttttatgccatatattgatgcatgttatgcaaaatatatgagtacacgaatccaataaaccaaagtatctatcgttttgagtaaacaacttcatagcaaattccacattctttttctttacttactctatacacgtcctcgtatttatccagtattttgatgatatccaactcagaaatggttgttgtattattgggtgtattgggagtataggtattattagctatgtaccaatttaccaaccctcttaatattgattgaacaatcacatcggttatccaatcaataaccacattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatgtaatgttattaatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgcatactcagccggtgtaatagatagatatatataattctattacaccggcagacaattaccgatcggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgatagtacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaaagaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtattcgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacattttttttgtaaaaatactcataaaaaaatttataaaaattatggcacaaccatatcttgtataggtagtttagttcgtcgagtgaacctataaacagataatagacaacacgtaataataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcgatgtcgtttcgatagcgttaccactatcggcgaatgatctgattatcatagcagcgaacaacaacatcagatatttcatcgacatttttgatggattttgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgatcataaacacggagtttattttatatgtctcgcataaacattactaaaaaaatatattgttctgtttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtctgtcatatgtatttcacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaaaaaggacaccactatcaatcgataacaagatctttgatatactaacggacaccattgatgactttagtaaatcatccgatctattgctgtgttatcttagatataaattcaatgggagcttaaactattacgttctgtacaaaggatccgacgaggatgaactcacttctcttcattactactgtaaacacatatccacgttctacaaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaagaagataatagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacgaaaagaaccattacaaatattatccatgatagaaagaaaatatctatatgattggagaagtaggaaacaggaacaagacgacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacaatgtacgccgtgtggttcgggtaccttcacatctcgcaataatcatttacccgcttgtctaagttgtaacggaagacgcgaccgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagtaatacctttaactatatcgatgtggaaattaatctgtatccagttaacgaccactaccggtctcagcgaatccatctcaacgtcggaactaactattactatgaatcataaagactgtaatcccgtatttcgtgaggaatacttctccgtccttaataaggtagcaacttcaggtttctttacaggagaaaggtgtgcactctgaatttcgagattaaatgcaataacaaaaatttttcctccaaacagttaacgaaagcaaagaatgatgacggtatcatgccgcattcggagactgtctatctagcgtcgacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaataataaatacaataattaatttctcgtaaaagtagaaaatatattctaatttattgcacggtaaggaagtagaatcataaagaacagtactcaatcaatagcaatcatgaaacaatatatcgtcctggcatgcatgtgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctctggctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaaggatggatttaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagggtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctcattttctctttctctcttcaatggagtcataaaatatttttattctctttctctcttcgatggtctcacaaaaatattaaacctctttctgatggtgtcactaaaatatttttattctcattctcattttctctttctctcttcaatggagtcataaaatatttttattctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcactaaaatattttttattctctttctgatgcatcaactatttcttaaacaataacgtccaacaacatatactcgtcgagcttatcaacatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagatcaactatctctttctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggtctctataaagcgatcgatctttcttacactctagagtttcctacagtcatgggtcacacatttttttctagacactaaataaaattagtaaaattaaattaattataaaattatatatataatttactaactttagttagataaattaataatatataagttttagtacattaatattatattttaaat

SEQ ID NO: 3 - DNA, 5498 bp, Artificial Sequence
  Description of Artificial Sequence: Synthetic polynucleotide
cgcgcgtaatacgactcactatagggcgaattggagctctttttatctgcgcggttaaccgcctttttatccatcaggtgatctgtttttattgtggagtctagattatcacagtgggacttggttcactgtactgtgataactgccctcaggagcacagtaacctggtgtgagttggacaacgataagttctccatcgttgatttgcaaatgctcgcacaaggtatcaggagcgtttacggtcaagtacaccttatccttgaaggccagtgaagcgactacagtaaagacgattcttctgccgtcgttcaacatagggattgagatagggttgtgatcctccctgaagtggaggtcaattttgacctcctggaaaaaagatcctttcaagtagatgatgtacagtccgtcacacttaatcactacggagttattctggacttccatcgtctgatactcgttcttgtaagaagaaataaacaattgaccatcttcacagcgggtcacagccccccgaaggcgttgtatgggggggtcttttgcaggtgaagagctaagttgcaaacacacatatatgaagcacagcaacataccggcccccttgatgccgcttacaacgagcctaagagtcttcttccatttaaagcgagggcgagacccgttttcgaggttctcgtccagaggctggaccccctcgccctccatggtggtggcctagaattcgatatcaagctcaggcctagatctgtcgacttcgagcttatttatattccaaaaaaaaaaaataaaatttcaatttttaagctttcactaattccaaacccacccgctttttatagtaagtttttcacccataaataataaatacaataattaatttctcgtaaaagtagaaaatatattctaatttattgcacggtaaggaagtagatcataactcgaggaattggggatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgcggatcccagcttttgttccctttagtgagggttaattgcgcgcagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagagcttttgggatcaataaatggatcacaaccagtatctcttaacgatgttcttcgcagatgatgattcattttttaagtatttggctagtcaagatgatgaatcttcattatctgatatattgcaaatcactcaatatgtagctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgacagatggaagggtcaaacttaataaaggatatttgttcgactttgtgattagtttgatgcgattcaaaaaagaatcctctctagctaccaccgcaatagatcctgttagatacatagatcctcgtcgcaatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatctcttggaatcaattacagatttctccgtgatagg

SEQ ID NO: 4 - DNA, 5272 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcatattacgatggtaacatatacgatttagctaaagatataaatgcgatgtcattcgacagttttataagatctctacaaaatatctcttcaaagaaagataaactcactgtttatggaaccatgggactgctgtctattgtcgtagatattaacaaaggttgtgatatatccaatatcaagttcgctgccggaataatcattttaatggagtatatttttgatgacacggatatgtctcatcttaaagtagcactctatcgtagaatacagagacgtgatgatgtagatagatatttttttttcctaaactgatttctctgtttaaattcgtagcgatatataaaacaacatgtaattaattaataaactttaagacatgtgtgttatactaagatggttggcttattccatagtagcttgtggaatttataaacttatgatagtaaaactagtacccaatatgtaaagatgaaaaagtaaattactattaacgccgtcggtattcgttcatccattcagtaagcttaaaaattgaaattttattttttttttttggaatataaataagctcgaagtcgacgaattcatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgactcgagtttacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggtaccaggcctagatctgtcgacttcgagcttatttatattccaaaaaaaaaaaataaaatttcaatttttctcgagtatgagtatagtgttaaatgacacttactaaatagccaaggtgattattcgtatttttttaaggagtaaccatgtccgcaattagatttattgcatgtctatatctcatttccatcttcggaaattgtcatgaggatccatattatcaaccatttgataaattaaacattactctagatatatacacttatgaggatctagtaccatacaccgtagacaatgacacaacttctttcgttaagatatactttaaaaatttttggattacggttatgactaaatggtgtgctccgtttattgataccgttagcgtatacacatctcatgataatctgaatatacaattttatagtagggacgaatatgatacacaaagcgaggataaaatttgtaccattgatgttaaagcacgatgcaaacatctaacaaaacgagaagttacagtacaacaagaagcctacagataatctagatgcattcgcgaggtaccgaatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 5 - DNA, 5087 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagattcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgcgatatcgcattttctaacgtgatggatatattaaagtcgaataaagtgaacaataattaattctttattgtcatcaggcctagaaaaagctagttcactaattccaaacccacccgctttttatagtaagtttttcacccataaataataaatacaataattaatttctcgtaaaagtagaaaatatattctaatttattgcacggtaaggaagtagatcataactcgacatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgatcacgaattctagctcaaaggacacagaattcaccaggattttgatggataagaatcagttctccgccattcacatggaagtcatccagggaggtattgtcagtggtcacattcaagtagactttgtctttgtaagtcagagaggccaccatcaaggagttgacagacctgaccttcttcagttggaagaggggctcctcatccttctggtaatgaaggctaatgttgacttcctgggagaagtagcccttcagggagatgagataaaacccatcacagttgatgatgactgagttgttctgcaccttcatgatttcatcctccttttgggaagtgaggatgaaacctttctccttcttatattcggtaaattgtactttgatactttgaattcgaggataccgatgtgatacctgaagagcagagaagtgcaggcagatgtaggtgaagcacaggagcagccccagtccctgaattacagaggccaccagcaatagcttgttcctctcgaatcttggcctggctgcatttcccacattctcttccaggggttggaccctttccatgaattcgtcgacttcgagcttatttatattccaaaaaaaaaaaataaaatttcaatttttaagctttattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacatcggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 6 - protein, 150 aa, Vaccinia virus
MGIQHEFDIIINGDIALRNLQLHKGDNYGCKLKIISNDYKKLKFRFIIRPDWSEIDEVKGLTVFANNYAVKVNKVDDTFYYVIYEAVIHLYNKKTEILIYSDDENELFKHYYPYISLNMISKKYKVKEENYSSPYIEHPLIPYRDYESMD

SEQ ID NO: 7 - DNA, 552 bp, Homo sapiens
atggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttga

SEQ ID NO: 8 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 9 - DNA, 597 bp, Artificial Sequence
  Description of Artificial Sequence: Synthetic polynucleotide
atggagggcgagggggtccagcctctggacgagaacctcgaaaacgggtctcgccctcgctttaaatggaagaagactcttaggctcgttgtaagcggcatcaagggggccggtatgttgctgtgcttcatatatgtgtgtttgcaacttagctcttcacctgcaaaagacccccccatacaacgccttcggggggctgtgacccgctgtgaagatggtcaattgtttatttcttcttacaagaacgagtatcagacgatggaagtccagaataactccgtagtgattaagtgtgacggactgtacatcatctacttgaaaggatcttttttccaggaggtcaaaattgacctccacttcagggaggatcacaaccctatctcaatccctatgttgaacgacggcagaagaatcgtctttactgtagtcgcttcactggccttcaaggataaggtgtacttgaccgtaaacgctcctgataccttgtgcgagcatttgcaaatcaacgatggagaacttatcgttgtccaactcacaccaggttactgtgctcctgagggcagttatcacagtacagtgaaccaagtcccactgtga

SEQ ID NO: 10 - protein, 198 aa, Artificial Sequence
  Description of Artificial Sequence: Synthetic polypeptide
MEGEGVQPLDENLENGSRPRFKWKKTLRLVVSGIKGAGMLLCFIYVCLQLSSSPAKDPPIQRLRGAVTRCEDGQLFISSYKNEYQTMEVQNNSVVIKCDGLYIIYLKGSFFQEVKIDLHFREDHNPISIPMLNDGRRIVFTVVASLAFKDKVYLTVNAPDTLCEHLQINDGELIVVQLTPGYCAPEGSYHSTVNQVPL

SEQ ID NO: 11 - DNA, 20 bp, Artificial Sequence
  Description of Artificial Sequence: Synthetic primer
ttgtcatcatgaacggcgga

SEQ ID NO: 12 - DNA, 20 bp, Artificial Sequence
  Description of Artificial Sequence: Synthetic primer
tccttcgtttgccatacgct

SEQ ID NO: 13 - DNA, 20 bp, Artificial Sequence
  Description of Artificial Sequence: Synthetic primer
cgttgtaagcggcatcaagg

SEQ ID NO: 14 - DNA, 20 bp, Artificial Sequence
  Description of Artificial Sequence: Synthetic primer
aaggccagtgaagcgactac

SEQ ID NO: 15 - protein, 8 aa, Gallus gallus
SIINFEKL

SEQ ID NO: 16 - protein, 17 aa, Artificial Sequence
  Description of Artificial Sequence: Synthetic peptide
ISQAVHAAHAEINEAGR

SEQ ID NO: 17 - protein, 27 aa, Artificial Sequence
  Description of Artificial Sequence: Synthetic peptide
REGVELCPGNKYEMRRHGTTHSLVIHD

SEQ ID NO: 18 - protein, 27 aa, Artificial Sequence
  Description of Artificial Sequence: Synthetic peptide
PSKPSFQEFVDWENVSPELNSTDQPFL

SEQ ID NO: 19 - protein, 27 aa, Artificial Sequence
  Description of Artificial Sequence: Synthetic peptide
SHCHWNDLAVIPAGVVHNWDFEPRKVS

SEQ ID NO: 20 - protein, 341 aa, Vaccinia virus
MLILTKVNIYMLIIVLWLYGYNFIISESQCPMINDDSFTLKRKYQIDSAESTIKMDKKRTKFQNRAKMVKEINQTIRAAQTHYETLKLGYIKFKRMIRTTTLEDIAPSIPNNQKTYKLFSDISAIGKASRNPSKMVYALLLYMFPNLFGDDHRFIRYRMHPMSKIKHKIFSPFKLNLIRILVEERFYNNECRSNKWRIIGTQVDKMLIAESDKYTIDARYNLKPMYRIKGKSEEDTLFIKQMVEQCVTSQELVEKVLKILFRDLFKSGEYKAYRYDDDVENGFIGLDTLKLNIVHDIVEPCMPVRRPVAKILCKEMVNKYFENPLHIIGKNLQECIDFVSE

SEQ ID NO: 21 - protein, 393 aa, Myxoma virus
MEGDYLIRPGEKQASYACRLLGILTKHSTYPPEEYFPLVRSIMSMYNTLIKDDVIWFREIAPYLYEYTMYKQNARNPSFYISTNVVNLTTCRVSKSSAKSAKYRAKSKQMKMRRVADGVPFEEKLKRDEAIRQKNKKDYFEIKKLYMRLKKFVRGKKSADDNMLCNKVRMIYGHINEIERVAVNEYSMAKSLLHYVFPNLFNDDKHHLFYRCTKMDGLGVLPSKKLNLIRVILENKFKISKRKWTMLKKYIDTVCATGKLRVRLGTYPYYKLKSLNALVASYQGDSVDELKTLVLSSFSLVDLTEKLIKTTFPEVVKSGEGHNYRCYPDGTHQGLDPERVIDMCYKARVATDSESVVDVHNAIVETVNRFLIRSEKKVGDNIDECIVMAKTIN

SEQ ID NO: 22 - DNA, 4425 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtaccgagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatataagcttgatcaggccttcactaattccaaacccacccgctttttatagtaagtttttcacccataaataataaatacaataattaatttctcgtaaaagtagaaaatatattctaatttattgcacggtaaggaagtagatcataactcgacatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgatcacgaattgttaacctgcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattattggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 23 - DNA, 4978 bp, Artificial Sequence
  Description of Artificial Sequence: Synthetic polynucleotide
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcattggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatggatccaaaaattgaaattttattttttttttttggaatataaataagctcgaagtcgacgaattcatgacagtactagctccagcttggtccccgacaacataccttctactactactattgctatcctccggactatctggaacccaggattgctcttttcagcactctccgatctcgtctgatttcgcggttaagatcagagagctatccgactacttgctacaggattacccagtaaccgtcgcgtccaacctacaagatgaagaactatgtggtggactttggagactagtcctagcgcaaagatggatggaaagacttaagaccgtagcgggatctaagatgcagggactactagaaagagtcaacaccgagatccacttcgtcacaaagtgtgcgtttcaaccaccaccgtcctgtctaagattcgtccagacaaacatctccagactactacaagaaacctccgagcagctagtagcgctaaaaccgtggatcacaagacagaacttctcgagatgtctagagctacagtgtcagccggattcttctacattaccaccaccatggtcaccaagaccactagaagctacagctccaactgctccacaaccaccattgctacttttgctattgctacccgtcggattgctactattagctgctgcttggtgtctacactggcagagaactagaagaagaactccaagaccgggagaacaagtaccaccagtaccatctccacaggacctactactagtcgagcacagaagaagaagaagatcgggagcgaccaacttctcgctattgaaacaagcgggagatgtcgaagaaaatccgggaccaatggaaagagtacagccgctagaagaaaacgtaggaaatgcggctagaccgagattcgagagaaacaagctactattggtcgcgtccgtcatccaaggactaggattgctattgtgcttcacctacatctgcctacacttctccgcgctacaagtctctcatagatacccgagaatccagtccatcaaggtccagttcaccgagtacaagaaagagaagggattcatcctaacctcgcagaaagaggacgagatcatgaaggtccagaacaactccgtcatcatcaactgcgacggattctacctaatctccctaaagggatacttctcccaagaagtcaacatctccttgcactaccagaaggatgaggaaccgctattccagctaaagaaagtcagatccgtcaactccctaatggtcgcctctctaacgtacaaggacaaggtctacctaaacgtcaccaccgacaacacatccctagatgatttccacgtaaacggtggagagctaatcctaatccatcagaacccgggagagttctgtgtattataagttaacaggcctgcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcactgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 24 - DNA, 5023 bp, Artificial Sequence
  Description of Artificial Sequence: Synthetic polynucleotide
ctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcattggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatggatccaaaaattgaaattttattttttttttttggaatataaataagctcgaagtcgacgaattcatgacagtactagctccagcttggtccccgacaacataccttctactactactattgctatcctccggactatctggaacccaggattgctcttttcagcactctccgatctcgtctgatttcgcggttaagatcagagagctatccgactacttgctacaggattacccagtaaccgtcgcgtccaacctacaagatgaagaactatgtggtggactttggagactagtcctagcgcaaagatggatggaaagacttaagaccgtagcgggatctaagatgcagggactactagaaagagtcaacaccgagatccacttcgtcacaaagtgtgcgtttcaaccaccaccgtcctgtctaagattcgtccagacaaacatctccagactactacaagaaacctccgagcagctagtagcgctaaaaccgtggatcacaagacagaacttctcgagatgtctagagctacagtgtcagccggattcttctacattaccaccaccatggtcaccaagaccactagaagctacagctccaactgctccacaaccaccattgctacttttgctattgctacccgtcggattgctactattagctgctgcttggtgtctacactggcagagaactagaagaagaactccaagaccgggagaacaagtaccaccagtaccatctccacaggacctactactagtcgagcacagaagaagaagaagatcgggagcgaccaacttctcgctattgaaacaagcgggagatgtcgaagaaaatccgggaccaatggagggcgagggggtccagcctctggacgagaacctcgaaaacgggtctcgccctcgctttaaatggaagaagactcttaggctcgttgtaagcggcatcaagggggccggtatgttgctgtgcttcatatatgtgtgtttgcaacttagctcttcacctgcaaaagacccccccatacaacgccttcggggggctgtgacccgctgtgaagatggtcaattgtttatttcttcttacaagaacgagtatcagacgatggaagtccagaataactccgtagtgattaagtgtgacggactgtacatcatctacttgaaaggatcttttttccaggaggtcaaaattgacctccacttcagggaggatcacaaccctatctcaatccctatgttgaacgacggcagaagaatcgtctttactgtagtcgcttcactggccttcaaggataaggtgtacttgaccgtaaacgctcctgataccttgtgcgagcatttgcaaatcaacgatggagaacttatcgttgtccaactcacaccaggttactgtgctcctgagggcagttatcacagtacagtgaaccaagtcccactgtgagttaacaggcctgcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcactgggcctcatgggccttccgctcactgcccgctttccagtcgggaaacctgtcgtgccagctgcattaacatggtcatagctgtttccttgcgtattgggcgctctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagaaccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 25 - DNA, 4371 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcttgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcgatatctcactaattccaaacccacccgctttttatagtaagtttttcacccataaataataaatacaataattaatttctcgtaaaagtagaaaatatattctaatttattgcacggtaaggaagtagatcataactcgacatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgatcacgaattgttaactgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttatgaatgaaattgtcgccaatcttacacccaaccccttgttatccattagtatagtattaacttcgttatttatgtcataaactgtaaatgattttgtagatgccatatcatacatgatattcatgtccctattataatcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 26 - DNA, 4397 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtaccgagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggttaccgccattgatgtttgttcattggatgagtaactactaatgtatacattttccatttataacacttatgtattaactttgttcatttatattttttcattattaagcttgatcaggccttcactaattccaaacccacccgctttttatagtaagtttttcacccataaataataaatacaataattaatttctcgtaaaagtagaaaatatattctaatttattgcacggtaaggaagtagatcataactcgacatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgatcacgaattgttaacctgcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattattggatcccgggcccgtcgactgcagaggcctgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 27 - DNA, 4924 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtaccgagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggttaccgccattgatgtttgttcattggatgagtaactactaatgtatacattttccatttataacacttatgtattaactttgttcatttatattttttcattattaagcttggatccaaaaattgaaattttattttttttttttggaatataaataagctcgaagtcgacgaattcatgacagtactagctccagcttggtccccgacaacataccttctactactactattgctatcctccggactatctggaacccaggattgctcttttcagcactctccgatctcgtctgatttcgcggttaagatcagagagctatccgactacttgctacaggattacccagtaaccgtcgcgtccaacctacaagatgaagaactatgtggtggactttggagactagtcctagcgcaaagatggatggaaagacttaagaccgtagcgggatctaagatgcagggactactagaaagagtcaacaccgagatccacttcgtcacaaagtgtgcgtttcaaccaccaccgtcctgtctaagattcgtccagacaaacatctccagactactacaagaaacctccgagcagctagtagcgctaaaaccgtggatcacaagacagaacttctcgagatgtctagagctacagtgtcagccggattcttctacattaccaccaccatggtcaccaagaccactagaagctacagctccaactgctccacaaccaccattgctacttttgctattgctacccgtcggattgctactattagctgctgcttggtgtctacactggcagagaactagaagaagaactccaagaccgggagaacaagtaccaccagtaccatctccacaggacctactactagtcgagcacagaagaagaagaagatcgggagcgaccaacttctcgctattgaaacaagcgggagatgtcgaagaaaatccgggaccaatggaaagagtacagccgctagaagaaaacgtaggaaatgcggctagaccgagattcgagagaaacaagctactattggtcgcgtccgtcatccaaggactaggattgctattgtgcttcacctacatctgcctacacttctccgcgctacaagtctctcatagatacccgagaatccagtccatcaaggtccagttcaccgagtacaagaaagagaagggattcatcctaacctcgcagaaagaggacgagatcatgaaggtccagaacaactccgtcatcatcaactgcgacggattctacctaatctccctaaagggatacttctcccaagaagtcaacatctccttgcactaccagaaggatgaggaaccgctattccagctaaagaaagtcagatccgtcaactccctaatggtcgcctctctaacgtacaaggacaaggtctacctaaacgtcaccaccgacaacacatccctagatgatttccacgtaaacggtggagagctaatcctaatccatcagaacccgggagagttctgtgtattataagttaacctgcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattattggatcccgggcccgtcgaccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 28 - DNA, 4969 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtaccgagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggttaccgccattgatgtttgttcattggatgagtaactactaatgtatacattttccatttataacacttatgtattaactttgttcatttatattttttcattattaagcttggatccaaaaattgaaattttattttttttttttggaatataaataagctcgaagtcgacgaattcatgacagtactagctccagcttggtccccgacaacataccttctactactactattgctatcctccggactatctggaacccaggattgctcttttcagcactctccgatctcgtctgatttcgcggttaagatcagagagctatccgactacttgctacaggattacccagtaaccgtcgcgtccaacctacaagatgaagaactatgtggtggactttggagactagtcctagcgcaaagatggatggaaagacttaagaccgtagcgggatctaagatgcagggactactagaaagagtcaacaccgagatccacttcgtcacaaagtgtgcgtttcaaccaccaccgtcctgtctaagattcgtccagacaaacatctccagactactacaagaaacctccgagcagctagtagcgctaaaaccgtggatcacaagacagaacttctcgagatgtctagagctacagtgtcagccggattcttctacattaccaccaccatggtcaccaagaccactagaagctacagctccaactgctccacaaccaccattgctacttttgctattgctacccgtcggattgctactattagctgctgcttggtgtctacactggcagagaactagaagaagaactccaagaccgggagaacaagtaccaccagtaccatctccacaggacctactactagtcgagcacagaagaagaagaagatcgggagcgaccaacttctcgctattgaaacaagcgggagatgtcgaagaaaatccgggaccaatggagggcgagggggtccagcctctggacgagaacctcgaaaacgggtctcgccctcgctttaaatggaagaagactcttaggctcgttgtaagcggcatcaagggggccggtatgttgctgtgcttcatatatgtgtgtttgcaacttagctcttcacctgcaaaagacccccccatacaacgccttcggggggctgtgacccgctgtgaagatggtcaattgtttatttcttcttacaagaacgagtatcagacgatggaagtccagaataactccgtagtgattaagtgtgacggactgtacatcatctacttgaaaggatcttttttccaggaggtcaaaattgacctccacttcagggaggatcacaaccctatctcaatccctatgttgaacgacggcagaagaatcgtctttactgtagtcgcttcactggccttcaaggataaggtgtacttgaccgtaaacgctcctgataccttgtgcgagcatttgcaaatcaacgatggagaacttatcgttgtccaactcacaccaggttactgtgctcctgagggcagttatcacagtacagtgaaccaagtcccactgtgagttaacctgcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacatgttattactaaggatgtattagctaataccaatttttttgttttcatacatatggtacgatgttgtaaagtgtacgaagcggttttacgacacgcatttgatgcacccacgttgtacgttaaagcattgactaagaattattggatcccgggcccgtcgaccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 29 - DNA, 2199 bp, Artificial Sequence
  Description of Artificial Sequence: Synthetic polynucleotide
atggaatggtcctttgtctttctttttttcttgtccgcagctgccggagtacattcggaggcgaagttgcaagagtccggacctgtacttgttaagcccggagcttcagtgaaaatgtcctgtaaagcatccggatatacctttacagattattatatgaattgggtgaagcaaagtcatggaaagagtcttgaatggataggagtaattaatccttataacggagatacatcttataatcaaaagttcaaaggaaaagctacactaactgttgataaatcctcaagtactgcttatatggaactaaactcactaactagtgaagattctgcagtttattattgtgctcgttattatggttcgtggtttgcatattggggacagggaaccttaataactgtaagtacagcaaaaacaacggcgccttctgtttatccattagcgcctgtatgtggagatacaactggttcttctgttacattaggatgtctagtcaaaggatatttcccagaacctgttacattaacctggaactccggttcgctatcatcaggtgtacacactttcccggcggttctacaatctgatttgtatacattatcatcttccgttacagttacttcttccacttggccatcgcaaagtatcacatgtaacgtagcgcacccagcttcatcaacaaaagtcgataaaaaaatagagccgcgaggtcccactataaagccgtgtccaccttgtaaatgtccagctcctaatttattaggaggacccagtgtatttattttccctcctaaaattaaagatgtattgatgatttctttatctccaattgttacatgcgtggttgtagatgtatccgaagacgatccggatgtgcaaatatcgtggttcgttaataatgtggaagttcacaccgcgcaaactcaaactcacagagaggattacaattctaccttgcgtgtagtgtcggctctacctatacaacaccaagattggatgtctggaaaagaatttaaatgcaaagttaataacaaagaccttccagcgccaatagaaagaacaatatccaaacctaaaggtagtgtaagagctcctcaagtatacgttttaccgcctcctgaagaagaaatgacgaaaaaacaagttacattaacctgtatggtgacagattttatgccagaggatatttatgtggagtggactaataatggaaaaacggaattgaattacaaaaatactgaacctgtattagatagtgatggatcatattttatgtacagtaaattgagagtggaaaaaaagaattgggttgaaagaaattcgtactcttgttcagttgtacatgagggactacataatcatcataccactaagagtttttcaagaacccctggtaaacgtagaaggcgtaggagatctggtgctactaatttctccttgttaaaacaagccggtgacgtcgaagaaaaccctggtcctatgatgacatggactctactattccttgccttccttcatcacttaacagggtcatgtgccgacatcgttatgacccaaactactctttcattacctgtgtcattaggagaccaggcatccatctcatgccgatcctctcaatcgatagtacactctaatggaaatacctatttagaatggtatttgcagaagccgggtcaatctccgaagttactaatttataaagtttctaacagattttcaggagttccagatagatttagtggttcaggatccggtactgactttacattaaagatctctcgtgtagaagctgaggatcttggtgtatattattgtttccaaggatctcacgtcccatatactttcggaggaggaaccaaactagaaattaagcgtgctgatgcggctcccacagtaagtatattcccaccgtcgtcagaacaattaacctcgggaggagcctcggtcgtttgtttcttaaataacttttatcctaaggatatcaacgttaaatggaaaattgatggttctgaacgtcagaatggagtgttgaattcatggactgatcaagattccaaagactctacttattcgatgtcgagtacacttactttaacaaaagatgaatatgaacgacataactcatatacttgtgaagcaacccataagacatctacttcaccaattgtaaagtcttttaatcgaaacgaatgctaa

SEQ ID NO: 30 - DNA, 4635 bp, Artificial Sequence
  Description of Artificial Sequence: Synthetic polynucleotide
gtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggagaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattatgacgagtttcggcacatattaatgcagggtgtatattattaagtgtggtgtttggtcgatgtaaaatttttgtcgataaaaattaaaaaataacttaatttattattgatctcgtgtataagctagcgcggttaaccgcctttttatccatcaggtgatctgtttttattgtggagtctagaactagtggatcccccgggctgcaggaattcgatatcaagctcaggcctagatctgtcgacttcgagcttatttatattccaaaaaaaaaaaataaaatttcaatttttaagcttttgaagttcctatactttctagagaataggaacttccactaattccaaacccacccgctttttatagtaagtttttcacccataaataataaatacaataattaatttctcgtaaaagtagaaaatatattctaatttattgcacggtaaggaagtagatcataactcgaggaattggggatctctataatctcgcgcaacctattttcccctcgaacactttttaagccgtagataaacaggctgggacacttcacacgcgtatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaagtaatgaagttcctatactttctagagaataggaacttccggttaaccggtgatatcacctctctggaagacagcgtgaataatgtactcatgaaacgtttggaaactatacgccatatgtggtctgtcgtatatgatcattttgatattgtgaatggtaaagaatgctgttatgtgcatacgcatttgtctaatcaaaatcttataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtgaatcagtcaaatttggtaattctattaatgttaaacatacatctgtttcagctaagcaactaagaacacgtatacggcagcagcttcctttatactctcatcttttaccaacacaaagggtggatatttgttcattggagttgataataatacacacaaagtaattggattcacggtgggtcatgactacctcagactggtagagaatgatatagaaaagcatatcaaaagacttcgtgttgtgcatttctgtgagaagaaagaggacatcaagtacacgtgtcgattcatcaaggtatataaacctggggatgaggcttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctattttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtca

SEQ ID NO: 31 - DNA, 4722 bp, Artificial Sequence
  Description of Artificial Sequence: Synthetic polynucleotide
atagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagctagcgcggttaaccgcctttttatccatcaggtgatctgtttttattgtggagtctagaactagtggatcccccgggctgcaggaattcgatatcaagctcaggcctagatctgtcgacttcgagcttatttatattccaaaaaaaaaaaataaaatttcaatttttaagcttttgaagttcctatactttctagagaataggaacttccactaattccaaacccacccgctttttatagtaagtttttcacccataaataataaatacaataattaatttctcgtaaaagtagaaaatatattctaatttattgcacggtaaggaagtagatcataactcgaggaattggggatctctataatctcgcgcaacctattttcccctcgaacactttttaagccgtagataaacaggctgggacacttcacacgcgtatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaatgaagttcctatactttctagagaataggaacttccggttaaccggtgatataggcaaccagcaataaaactaatttattttatcatttttttattcatcatcctctggtggttcgtcgtttctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctatcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctattttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtca

SEQ ID NO: 32 - DNA, 4542 bp, Artificial Sequence
  Description of Artificial Sequence: Synthetic polynucleotide
tagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatataagctagcgcggttaaccgcctttttatccatcaggtgatctgtttttattgtggagtctagaactagtggatcccccgggctgcaggaattcgatatcaagctcaggcctagatctgtcgacttcgagcttatttatattccaaaaaaaaaaaataaaatttcaatttttaagcttttgaagttcctatactttctagagaataggaacttccactaattccaaacccacccgctttttatagtaagtttttcacccataaataataaatacaataattaatttctcgtaaaagtagaaaatatattctaatttattgcacggtaaggaagtagatcataactcgaggaattggggatctctataatctcgcgcaacctattttcccctcgaacactttttaagccgtagataaacaggctgggacacttcacacgcgtatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaagtaatgaagttcctatactttctagagaataggaacttccggttaaccggtgatatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggtcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctattttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtca

SEQ ID NO: 33 - DNA, 4418 bp, Artificial Sequence
  Description of Artificial Sequence: Synthetic polynucleotide
attggagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctaaatttcagtttatgtttgtaccccgtattcatacttaacaaattggtattacataccattaataatgcaagcataaaaaatcgttagtagatgtttctaaatataggttccgtaagctagcgcggttaaccgcctttttatccatcaggtgatctgtttttattgtggagtctagaactagtggatcccccgggctgcaggaattcgatatcaagctcaggcctagatctgtcgacttcgagcttatttatattccaaaaaaaaaaaataaaatttcaatttttaagcttttgaagttcctatactttctagagaataggaacttccactaattccaaacccacccgctttttatagtaagtttttcacccataaataataaatacaataattaatttctcgtaaaagtagaaaatatattctaatttattgcacggtaaggaagtagatcataactcgaggaattggggatctctataatctcgcgcaacctattttcccctcgaacactttttaagccgtagataaacaggctgggacacttcacacgcgtatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaatgaagttcctatactttctagagaataggaacttccggttcactcgacgaactaaactacctatacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccgtttttatcagtatgtatatctatatcaacgtcgtcgttgtagtgagctccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctattttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtca

SEQ ID NO: 34 - DNA, 5510 bp, Artificial Sequence
  Description of Artificial Sequence: Synthetic polynucleotide
cgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttaatatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggactttaagctagcgcggttaaccgcctttttatccatcaggtgatctgtttttattgtggagtctagaactagtggatcccccgggctgcaggaattcgatatcaagctcaggcctagatctgtcgacttcgagcttatttatattccaaaaaaaaaaaataaaatttcaatttttaagcttttgaagttcctatactttctagagaataggaacttccactaattccaaacccacccgctttttatagtaagtttttcacccataaataataaatacaataattaatttctcgtaaaagtagaaaatatattctaatttattgcacggtaaggaagtagatcataactcgaggaattggggatctctataatctcgcgcaacctattttcccctcgaacactttttaagccgtagataaacaggctgggacacttcacacgcgtatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaatgaagttcctatactttctagagaataggaacttccggttaaccggtgattgtatttttctcatgcgatgtgtgtaaaaaaactgatattatataaatattttagtgccgtataatgaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaaaaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagtggaagatacaactgttacgttcattacgacgacgttagaatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaaccctacaactacagtagtattggagtccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctattttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtca

SEQ ID NO: 35 - DNA, 1788 bp, Artificial Sequence
  Description of Artificial Sequence: Synthetic polynucleotide
atgtgtcaccagcagctagtgatctcgtggttctccctagtatttctagcctctccgctagtagcgatctgggagctaaaaaaggatgtctacgtcgtcgagctagactggtatccagatgctccgggagaaatggtagtcctaacatgtgatacaccggaagaggatggaatcacctggaccttggatcaatcctccgaagtactaggatccggaaagaccctaaccatccaagtcaaagaattcggagatgcgggacagtacacctgtcacaaaggtggagaagtcctatcgcactccctactactattgcacaagaaagaggacggtatctggtccaccgatatcctaaaggatcagaaagagccgaagaacaagaccttcctaagatgcgaagcgaagaactactccggaagattcacatgttggtggctaaccacaatctccaccgacctaaccttctccgtcaaatcttctagaggatccagtgatccgcagggtgtaacatgtggtgctgctacattatctgcggagagagtcagaggagacaacaaagagtacgagtactccgtcgagtgtcaagaggattctgcttgtccagctgcggaagaatctctaccgatcgaagtaatggtagacgcggtccacaagttgaagtacgagaactacacctcctcgttcttcatcagagacatcatcaaaccagatccgccgaagaatctacagctaaagccgctaaagaactccagacaggtcgaagtatcttgggaatacccggatacttggtctacaccgcactcctacttttcgttgaccttctgtgtacaagtccagggaaagtccaagagagagaagaaggacagagtctttaccgacaagacatccgcgaccgtcatctgtagaaagaacgcctctatttctgtcagagcgcaggacagatattactcctcgtcttggagtgaatgggcgtctgtaccatgttccagaagaagaagaagaagagcgaccaacttctcgctattgaagcaagcgggagatgtagaagaaaatccgggaccgttagatatgtgtccggcgagatctctactactagtcgcgacactagtcctactagaccatctatctctagcgagaaatttgccagtagcgacaccagatcctggaatgtttccgtgtctacaccactcgcagaatctactaagagccgtgtctaacatgctacagaaggcgagacagaccttggaattctacccgtgtacctccgaagaaatcgatcacgaggatatcaccaaggacaagacctctacagtcgaagcttgtctaccgctagagttgaccaagaacgagtcctgcctaaactccagagaaacctccttcatcaccaacggatcttgcctagcgtctagaaagacctctttcatgatggcgctatgcctatcctctatctacgaggacctaaagatgtaccaggtcgaattcaagaccatgaacgcgaagctactaatggacccgaagagacagatcttcttggaccagaatatgctagcggtcatcgacgaactaatgcaggcgctaaacttcaactctgaaaccgtgccgcagaagtccagtttagaagaaccggatttctacaagaccaagatcaagctatgcatcctactacacgcgttcagaatcagagcggtcaccatcgatagagtcatgtcttacctaaacgcgtccagaagaccgaaaggaagaggaaagagaagaagagaaaagcaaagaccgaccgactgccatctatga

SEQ ID NO: 36 - protein, 595 aa, Artificial Sequence
  Description of Artificial Sequence: Synthetic polypeptide
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSRRRRRRATNFSLLKQAGDVEENPGPLDMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASRRPKGRGKRRREKQRPTDCHL

SEQ ID NO: 37 - DNA, 1797 bp, Mus sp.
atgtgtccacaaaagctcaccatctcatggttcgctatagtattgctcgtttccccattgatggcaatgtgggagcttgaaaaagatgtgtatgtagtggaggttgactggactcctgatgcacccggagagacagtcaatttgacatgcgacacccccgaagaagatgatattacatggacatccgaccaacggcacggggtcatcggatctgggaagaccttgacaattacagtgaaggagttcttggatgcaggacagtacacatgtcataaagggggcgagacactctcacattcacatctgctcctgcataaaaaggagaacggaatctggtccaccgaaatccttaagaatttcaagaacaaaacctttcttaagtgtgaggcccctaattattccggaagatttacatgcagctggttggtccagcgcaatatggacctcaaatttaatatcaagtcttcttccagctccccagattctcgggcagtgacttgcggcatggcatccctctccgctgagaaagtaacattggatcaacgagactacgagaagtactctgttagttgtcaagaggacgttacatgccctaccgcagaagagacattgccaattgaattggcccttgaagcacgccagcagaataagtacgaaaattacagtacaagctttttcatccgagacataattaaacccgatcctcctaagaatctccaaatgaaacctttgaagaatagccaagtggaagtttcatgggagtatccagattcctggtccacaccacattcctatttctcccttaagttcttcgtcagaatccagaggaagaaagaaaagatgaaggaaaccgaggaaggctgcaaccagaagggcgcctttctggtagagaaaaccagcactgaggttcagtgtaaggggggaaacgtgtgtgtgcaggcacaagatcgatactacaactcaagctgtagtaaatgggcctgcgtaccttgtcgggttcgatccagacgacgccggagacgagctaccaatttttccttgctcaagcaggcaggcgatgtggaggaaaacccagggccccttgacatgtgtcagagccggtacctccttttcctcgcaaccctggctctgcttaaccacctctcactggctagggtaattcccgtatctgggcctgcccgatgcctcagccagagtcggaatctccttaagaccacagacgatatggtaaaaacagcaagggagaaactcaaacattactcttgtacagcagaggacatcgatcatgaagacataacccgggaccagacctcaacattgaaaacttgtctgccactggagcttcataagaacgagtcctgccttgccacacgagagacctctagcactacacgggggtcctgcctgcctccacagaaaacctccttgatgatgaccctgtgtctcggcagtatttacgaagatttgaagatgtaccaaacagagtttcaggccattaacgcagcattgcaaaaccataatcaccagcagataatccttgataagggtatgctggtagccatcgacgaacttatgcaatctctgaatcataatggcgaaactctgcgacaaaagcccccagttggagaagccgacccctaccgagtcaagatgaaactctgcatactcctgcatgccttttccacacgggttgttactatcaatcgagtcatggggtatctttcttcagcacggcgccctaaagggcgcggaaaacgccgccgggaaaaacaaagacctactgattgccatctgtga

SEQ ID NO: 38 - protein, 598 aa, Artificial Sequence
  Description of Artificial Sequence: Synthetic polypeptide
MCPQKLTISWFAIVLLVSPLMAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSRRRRRRATNFSLLKQAGDVEENPGPLDMCQSRYLLFLATLALLNHLSLARVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSARRPKGRGKRRREKQRPTDCHL

SEQ ID NO: 39 - DNA, 4380 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccatcaaaataaaattggataaggaaaagacgttcaaattcgtcatcgtattggaaccggagtggatagatgagataaaacctatatacatgaaagttaacgacgagtcggtggagttagaattagactataaagacgccatcaaacgcatctattcggcggaggtggtattatgttcagattccgtgatcaacctgttcagtgacgtcgacgtgtcttatacgtgcgaataccctacgattaaggtgaatacgataaaaaaatactacagcgtacagaacagagggatgacctacgtacatatagaatcgcccattaatacgaaagataaatgctggttcgtggaaaagaacggatggtacgaggatagaacacattcgtaatttttttatatagtgaaaaataatgtgagcattacgagcgtgggtttatctacacggctagcaaaaattgaaattttattttttttttttggaatataaataagctcgaagtcgacagatctaggcctggtaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaaagctagcgatcaggcctttttttttattgaaaaataatagtaagaaaacgttgccgtaaacatggaggagggtatcgtgcataaattagacgtgtttctcatcgacgaaaacgtgtctataaaacacgttaatttgttcgacggggatagttacgggtgcaacatccatttaaagaccgccacgtgtaagtacatcacctttatattagtcttagaacccgattgggagaacatagtcgaggcaaaacccattcacatgagattgaacggcaaaaagatacgcgtaccactcgtagcaaaaacccacacgtcacttatttataaagtcgttatctacgtggaggaagacgccctcgcacgattctacagcgacgtggaaaggtcgtacacggacgtgtatcccacgtttctagtcaatacggatacgcgacgttattacattttggatagcggacggacgtatacgtacatagatccgtttatatcggacgaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 40 - DNA, 4416 bp, Artificial Sequence
  Description of Artificial Sequence: Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtaccatggaactgataaaatctttacacacgtccacggacttaacggtctacagaacatcaatgctccatcaccgtaatatgcccgagaaggagtactgcttcacgcagatatactcggctacgttaaacatagacaccaagtcgaccgtcagttttcgtagtacgatacacgacgggtttctttcgacgtatccgacgatctacattaatccggaggaaaaatattacaaagtccagaacaaaggacgtctgcggatgcgggtggttacacctatcttaaacagcgacaaactacagttcatggataagggcgagatgtatgcgggtgtcggcgacgacccatcgatcgtagacagtagcgatagcgacgattataccagcagtgaggaagacacggaggaggaagacacggaggaggaagaagattgattttttttattgaaaaataatagtaagaaaacgttgccgtaaacgctagcaaaaattgaaattttattttttttttttggaatataaataagctcgaagtcgacagatctaggcctggtaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaaagctagcgatcaggcctgtttttattataatgatttttaaatttaaacgttattaaaaatggaaccggtatctatggacaaaccctttatgtacttcgatgaaatagacgatgaattagagtatgaacccgaaagcgttaacgaaacacctaaaaaactcccccaccaggggcagttgaaattattgctaggcgagttgttttttctaagtaaattacaacgccacggcattttagacggatccacgatcgtgtatataggatccgctcccggcacccacatcaaatacttacgcgatcattttatgtctatgggattggttattaaatggatgttgatcgacggacgcacgcacgatcccatccttgaaggattacgcgacgtaattctcattaccaagttcgtcgacgaggcgtacattcgacagttgaagaaacaactgtatccgtctagggttattctcatttcggacgtgcgctcgaaacggggacagaaaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 41 - DNA, 4416 bp, Artificial Sequence; identical to SEQ ID NO: 40
  Description of Artificial Sequence: Synthetic polynucleotide

SEQ ID NO: 42 - protein, 393 aa, Myxoma virus
MEGDYLIRPGEKQASYACRLLGILTKHSTYPPEEYFPLVRSIMSMYNTLIKDDVIWFREIAPYLYEYTMYKQNARNPSFYISTNVVNLTTCRVSKSSAKSAKYRAKSKQMKMKRVADGVPFEEKLKRDEAIRQKNKKDYFEIKKLYMRLKKFVRGKKSADDNMLCNKVRMIYGHINEIERVAVNEYSMAKSLLHYVFPNLFNDDKHHLFYRCTKMDGLGVLPSKKLNLIRVILENKFKISKRKWTMLKKYIDTVCATGKLRVRLGTYPYYKLKSLNALVASYQGDSVDELKTLVLSSFSLVDLTEKLIKTTFPEVVKSGEGHNYRCYPDGTHQGLDPERVIDMCYKARVATDSESVVDVHNAIVETVNRFLIRSEKKVGDNIDECIVMAKTIN

SEQ ID NO: 43 - protein, 384 aa, Yokapox virus
MKKYIIYSDSTMTAINMFSGESVLSYTIRLFLKLHSDDIQDVDKCLNSIRLKLSREFPEVNDNFIWNRKYVNSIYTSSACLKLINENIQKKELELMEIEKKKNIYKKKAKIIKNINEKNRLYTSHYNSLKSGYIKCLSVLNKFSRSKHVPNIPNIKKIVKLFSDLSTICKAAKNPKSLVYSLIHYMFPDLFGKDNRFIYYRIKPKKRTLKQLSPFKMNLIKILVEDRFFHNKIITYTWERIRIVLDRIFDNMASINQVDTMYKLKPLYKIKIKNENDKAFIKEIVSECITTQELVEKVLKRLFVDIFKDGSYTSYRHDSDDNEYIPLDKIKLEIVHSIVDPCIYAPKHMSYLICREMINKYFENPTHIIGKNIQECVEIAKKSI

SEQ ID NO: 44 - protein, 368 aa, Murmansk poxvirus
MAMNIVPGECASTYANRLFVKLYDENQNVSKCLNIIRSQLSSEFPEVNDDFIWMRKYVNNIYESNNCRSLINEYIKKTKLELVKIEKKKLLYSQKAKIIKDINANKRLSIMHYNSLKTGYIKCLSILQKITKAKYVPNIDNFPKIIKLFYDLSTICKNSKKPTTLVYALINYMFPDLFGNDNRFIYYRINPKRRLKIKQLSPFKMNLIKILVEDTFFRNKTLTHVWDKIRLEVDRMLDNKASNLEMDTIYKIKPLWTIYVKDENDKEFIKDMARECISTQELLEKTLKKLFTDMFKDGSYKMYRHDADDKYMGLDKIKLDIIHRIVDPCIIAPKRIAYLICKDMINNYFEKPTHIIGSNLQKCIDIKL

SEQ ID NO: 45 - protein, 133 aa, Monkeypox virus
MINDDSFTLKRKYQIDSAESTMKMDKTMTKFQNRVKMVKEINQTIRAAQTHYETLKLGYIKFKGMIRTTTLEDIAPSIPNNQKTYKLFSDISVIGKASQNPSKMIYARCFTCFPICLEMTIDSFVIECIQHCS

SEQ ID NO: 46 - protein, 321 aa, Akhmeta virus
MSGNFGQRKIDNDLIRRLALKRKYQLNGEESTTKVDKKRTKFQNRAKMVKEINESIRVAQSHYETLKLGYIKFKRMIRTTTLKDIVTSIPNFQKVYKLFLDISAISKASQTPSKMVYALLLYMFPNLFGDDHRFIRYRMYPMSKIKHKIFSPFKLNLIRILVEERFYNDECRYNRWRVIGSQVDKMLVAKSDKYKIDAMYRLRPAYRIKGNSEEDTLFIKQIVEKCVTSQELVEKVLKMLFTDLFKSGEYKMYRHDADAENGFIGLDKIKLNIVHDIVEPCMPVRRSLARAQCKEMVNKYFENPLHILGKNLQECIDFVSE

SEQ ID NO: 47 - protein, 331 aa, Ectromelia virus
MLIIVLWLYGYNFIMSGSQCRMINDDSFTLKRKYQINSVESTMKMDKKRTKFQNRAKMVKEINQTIRAAQTHYETLKLGYIKFKRMIRTTTLEDIATSIPNIQKIYKLFSDISAIGKASQNPSKMVYALLLYMFPNLFGDDHRFILYRMHPMSKIKHKIFSPFKLNLIRILVEERFYNNECKDYRWKIIGSQVDKILIAESAKYTMNAMYRLRPIHRIKVESEEDTLFIKQMVEKCVTSQELVEKMLKILFRDLFKSGEYKAYRYDDDVENGFIGLDKLKLNIVHDIVEPCMPVRRPVAKILCKEMVNKYFENPLHIIGKNLQECIDFVSE

SEQ ID NO: 48 - protein, 331 aa, Orthopoxvirus
MLIIVLWLYGYNFIMSGSQCQMINDDSFTLKRKYQINSVESTMKMDKKRTKFQNRAKMVKEINQTIRAAQTHYETLKLGYIKFKRMIRTTTLEDMATSIPNIQKIYKLFSDISAIGKASQNPSKMVYALLLYMFPNLFGDDHRFILYRMHPMSKIKHKIFSPFKLNLIRILVEERFYNNECKDYRWKIIGSQVDKILIAESAKYTIDAMYRLRPIYRIKVESEEDTLFIKQMVEKCVTSQELVEKVLKILFRDLFKSGEYKAYRYEDDAEKGFIGLDKLKLNIVHYIVEPCMPVRRPVAKILCKEMVNKYFENPLHIIGKNLQECIDFVSE

SEQ ID NO: 49 - protein, 343 aa, Cowpox virus
MLILTKVNIYMLIIVLWLYGYNFIMSGSQCPMINNDLYRFTLKRKYQINSEELTMKMDKKRTKFQNRAKMVKEINQTIRAAQTHYETLKLGYIKFKRMIRTTTLEDIAPSIPNIQKTYKLFSDISAIGKASQNPSKMVYALLLYMFPNLFGDDHRFIRYRMHPMSKIKHKIFSPFKLNLIRILVEERFYNNECRDYKWRIIGTQVDKILIAESAKYTIDAMYRLRPIYRIKVESEEDTLFIKQMVEQCVTSQELVEKMLKILFRDLFKSGEYKAYRYDDDVDNGFIGLDKLKLNIVHNIVEPCMPVRRPVAKILCKEMVNKYFENPLHIIGKNLQECIDFVSE

SEQ ID NO: 50 - protein, 329 aa, Camelpox virus
MLIIVLWLYGYNFIMSGSQCPMINDDSFTLKRKYQIDSAESTMKMDKRTKFQNRAKMVKEINQTIRAAQTHYETLKLGYIKFKKMIMTTTLEDIATSIPNIQKIYKLFSDISAIGKASQNPIKMVYALLLFMFPNLFGDDHRFILYRIHPMSKIKHKIFSPFKLNLIRILVEERFYNNECRSNKWRIIGTQVDKMLIAESDKYTIDARYRLRPIYRIKGESEEDTLFIKQMVEQCVTSQELVEKVLKILFRDLFKSGEYKAYRYDDVENVFIGLDKLKLNILHDIVEPCMPVRRPVAKILCKEMVNKYFENPLHIIGKNLQECIDFVNE

SEQ ID NO: 51 - protein, 341 aa, Variola virus
MLILTKVNIYMLIIVLWLYGYNFIMSGSQCPMINDDRFTLKRKYQIDSVESTMKMDKKRTKFQNRAKMVKEINQTIRAAQTHYETLKLGYIKFKKMIRTTTLEDITTSIPNIQKIYKLFSDISAIGKVSQNPSKMAYALLLYMFPNLFGDDHRFILYRMFPMSKIKHKIFSPFKLNLIRILVEERFYNNECRSNKWRIIGTQVDKMLIAESDKYTIDARYRLRPIYRIKGKSEEDTLFIKQMVDQCVTSQELVEKVLKILFRDLFKSGEYKAYRYDDDVENGFIGLDKLKLNIVHDIVEPCMPVRRPVAKILCKEMVNKYFENPLHIIGKNLQECIDFVSE

SEQ ID NO: 52 - protein, 317 aa, Variola virus
MSGSQCPMINDDSFTLKRKYQIDSVESTMKMDKKRTKFQNRAKMVKEINQTIRAAQTHYETLKLGYIKFKKMIRTTTLEDITTSIPNIQKIYKLFSDISAIGKVSQNPSKMAYALLLYMFPNLFGDDHRFILYRMFPMSKIKHKIFSPFKLNLIRILVEERFYNNECRSNKWRIIGTQVDKMLIAESDKYTIDARYRLRPIYRIKGKSEEDTLFIKQMVDQCVTSQELVEKVLKILFRDLFKSGEYKAYRYDDDVENGFIGLDKLKLNIVHDIVEPCMPVRRPVAKILCKEMVNKYFENPLHIIGKNLQECIDFVSE

SEQ ID NO: 53 - protein, 317 aa, Buffalopox virus
MSGSQCPMINNDSFTLKRKYQIDSAESTIKMDKKRIKFQNRAKMVKEINQTIKAAQTHYETLKLGYIKFKRMIMTTTLEDIAPSIPNNQKTYKLFSDISAIGKASQNPSKMVYALLLYMFPNLFGDDHRFIRYRMHPMSKIKHKIFSPFKLNLIRILVEERFYNNECRSNKWKIIGTQVDKMLIAESDKYTIDARYNLKPMYRIKGESEEDTLFIKQMVEQCVTSQELVEKVLKILFRDLFKSGEYKAYRYDDDVENGFIGLDTLKLNIVHDIVEPCMPVRRPVAKILCKEMVNKYFENPLHIIGKNLQECIDFVSE

SEQ ID NO: 54 - protein, 331 aa, Horsepox virus
MLIIVLWLYGYNFIMSESQCPMINDDSFTLKRKYQIDSAESTIKMDKKRTKFQNRAKMVKEINQTIRAAQTHYETLKLGYIKFKRMIMTTTLEDIAPSIPNNQKTYKLFSDISAIGKASRNPSKMVYALLLYMFPNLFGDDHRFIRYRMHPMSKIKHKIFSPFKLNLIRILVEERFYNNECRSNKWRIIGTQVDKMLIAESDNYTIDARYNLKPMYRIKGESEEDTLFIKQMVEQCVTSQELVEKVLKILFRDLFKSGEYKAYRYDDDVENGFIGLDTLKLNIVHDIVEPCMPVRRPVAKILCKEMVNKYFENPLHIIGKNLQECIDFVSE

SEQ ID NO: 55 - protein, 331 aa, Variola virus
MLIIVLWLYGYNFIMSGSQCPMINDDSFTLKRKYQIDSAESTIKMDKKRIKFQNRAKMVKEINQTIRAAQTHYETLKLGYIKFKRMIRTTTLEDIAPSIPNNQKTYKLFSDISAIGKASQNPSKMVYALLLYMFPNLFGDDHRFIRYRMHPMSKIKHKIFSPFKLNLIRILVEERFYNNECRSNKWRIIGTQVDKMLIAKSDNYTIDARYNLKPMYRIKGKSEEDTLFIKQMVEQCVTSQELVEKVLKILFRDLFKSGEYKAYRYDDDVENGFIGLDTLKLNIVHDIVEPCMPVRRPVAKILCKEMVNKYFENPLHIIGKNLQECIDFVSE

SEQ ID NO: 56 - protein, 341 aa, Vaccinia virus
MLILTKVNIYMLIIVLWLYGYNFIMSGSQCPMINDDSFTLKRKYQIDSAESTMKMDKKRTKFQNRAKMVKEINQTIRAAQTHYETLKLGYIKFKRMIRTTTLEDIAPSIPNNQKTYKLFSDISAIGKASQNPSKMVYALLLYMFPNLFGDDHRFIRYRMHPMSKIKHKIFSPFKLNLIRILVEERFYNNECRSNKWRIIGTQVDKMLIAESDKYTIDARYNLKPMYRIKGKSEEDTLFIKQMVEQCVTSQELVEKVLKILFRDLFKSGEYKAYRYDDDVENGFIGLDTLKLNIVHDIVEPCMPVRRPVAKILCKEMVNKYFENPLHIIGKNLQECIDFVSE

SEQ ID NO: 57 - protein, 341 aa, Rabbitpox virus
MLILTKVNIYMLIIVLWLYGYNFIMSESQCPMINDDSFTLKRKYQIDSAESTIKMDKKRIKFQNRAKMVKEINQTIRAAQTHYETLKLGYIKFKRMIRTTTLEDIAPSIPNNQKTYKLFSDISAIGKASQNPSKMVYALLLYMFPNLFGDDHRFIRYRMHPMSKIKHKIFSPFKLNLIRILVEERFYNNECRSNKWRIIGTQVDKMLIAESDKYTIDARYNLKPMYRIKGKSEEDTLFIKQMVEQCVTSQELVEKVLKILFRDLFKSGEYKAYRYDDDVENGFIGLDTLKLNIVHDIVEPCMPVRRPVAKILCKEMVNKYFENPLHIIGKNLQECIDFVSE

SEQ ID NO: 58 - protein, 331 aa, Modified Vaccinia Ankara virus
MLIIVLWLYGYNFIMSGSQCPMINDDSFTLKRKYQIDSAESTIKMDKKRIKFQNRAKMVKEINQTIRAAQTHYETLKLGYIKFKRMIRTTTLEDIAPSIPNNQKTYKLFSDISAIGKASQNPSKMVYALLLYMFPNLFGDDHRFIRYRMHPMSKIKHKIFSPFKLNLIRILVEERFYNNECRSNKWRIIGTQVDKMLIAESDKYTIDARYNLKPMYRIKGKSEEDTLFIKQMVEQCVTSQELVEKVLKILFRDLFKSGEYKAYRYDDDVENGFIGLDTLKLNIVHDIVEPCMPVRRPVAKILCKEMVNKYFENPLHIIGKNLQECIDFVSE

SEQ ID NO: 59 - protein, 326 aa, Raccoon poxvirus
MSGSFVGQFEEMDDGIGYPKLYSSSLKRKYNINSEESNMKSDKKKLKFQNRARLVKEVNGTIREAQLHYVSLKRGYILFKKMLKTTTLDTITSTPNLQKIYKLFFDLSSICNVAETPQKMVYALLIYMFPNVFGHDNRFIYYRIQPISKIKFRIFSPFKLNLIRILVEEKFYNNESKFRKWKAIGTQVDKMLAAESAKYKINEMYRLRSIHRIKTDSEDDTIFIKHMAEKCSTSQELVEKVLKLLFADLFKTGDYKLYRHDDDVENGFIGLDKIKLDIVHEIVEPCMTGSRTLASAPCKEMINKYFENPLHIIGKNIQECIEIARS

SEQ ID NO: 60 - protein, 327 aa, Skunkpox virus
MSGSFVGQFEEMDEESVYHQDHKFTLKRKYNINSEETIMETTEKKRTKFQSRAKLVKEVNGTIRAAQMHYISLKRGYIVFKKMLKTTTLDAITSIPNFQKIYKLFFDISAISNVATSPRKMVYALLLYMFPNLFGGDNRFIHYRIQPLSKIKHKIFSPFKINLIRILVEEKFYNNESKYRRWKMIGSQVDKMLAAESAKCTVDTMYRLRPIHRIKTDSDDDTIFIKQIAEKCSTSQELVEKVLKLLFTDLFKSGDYKVFRHDEDAENGFIGLDKIKLNIVHEIVEPCLSVHRSLARAPCKEMVNKYFENPLHIIGKNLQECIDFVRS

What is claimed is:

1. A modified vaccinia Ankara (MVA) virus genetically engineered to comprise a knocked out E5R gene (MVAΔE5R) and a knocked out E3L gene (ΔE3L) (MVAΔE5RΔE3L).

2. The MVAΔE5RΔE3L virus of claim 1, wherein the virus further comprises one or more heterologous nucleic acid molecules encoding one or more of OX40L, hFlt3L, hIL-2, hIL-12, hIL-15, hIL-15/IL-15Rα, hIL-18, IL-21, anti-huCTLA-4, anti-huPD-1, anti-huPD-L1, GITRL, 4-1BBL, or CD40L, and/or a knockout of any one or more of thymidine kinase (ΔTK), C7 (ΔC7L), B2R (ΔB2R), WR200, K7R, C12L, B8R, B14R, N1L, C11R, K1L, M1L, N2L, or WR199.

3. The MVAΔE5RΔE3L virus of claim 2, wherein, when the virus further comprises one or more heterologous nucleic acids, the heterologous nucleic acids are expressed from within one or more viral genes selected from the group consisting of the thymidine kinase (TK) gene, the C7 gene, the C11 gene, the K3 gene, the F1 gene, the F2 gene, the F4 gene, the F6 gene, the F8 gene, the F9 gene, the F11 gene, the F14.5 gene, the J2 gene, the A46 gene, the E3L gene, the WR200 gene, the E5R gene, the K7R gene, the C12L (IL18BP) gene, the B8R gene, the B14R gene, the N1L gene, the K1L gene, the C16 gene, the M1L gene, the N2L gene, and the WR199 gene.

4. The MVAΔE5RΔE3L virus of claim 1, wherein the knocked out E5R gene comprises replacement of at least a portion of the E5R gene with one or more gene cassettes comprising one or more heterologous nucleic acid molecules.

5. An immunogenic composition comprising the MVAΔE5RΔE3L virus of claim 1.

6. The immunogenic composition of claim 5, further comprising a pharmaceutically acceptable carrier and/or adjuvant.

7. A nucleic acid sequence encoding the MVAΔE5RΔE3L virus of claim 1.

8. A kit comprising the MVAΔE5RΔE3L virus of claim 1 and instructions for use thereof.

9. A method for treating a tumor in a subject in need thereof, the method comprising delivering to a tumor a composition comprising an effective amount of the MVAΔE5RΔE3L virus of claim 1, wherein the virus further comprises a heterologous nucleic acid molecule encoding hFlt3L and a heterologous nucleic acid molecule encoding hOX40L (MVAΔE3LΔE5R-hFlt3L-hOX40L).

10. The method of claim 9, wherein the treatment comprises one or more of the following: inducing an immune response in the subject against the tumor or enhancing or promoting an ongoing immune response against the tumor in the subject, reducing the size of the tumor, eradicating the tumor, inhibiting the growth of the tumor, inhibiting metastatic growth of the tumor, inducing apoptosis of tumor cells of the tumor, or prolonging survival of the subject.

11. The method of claim 9, wherein the composition is administered by intratumoral or intravenous injection or a simultaneous or sequential combination of intratumoral and intravenous injection.

12. The method of claim 9, wherein the tumor is melanoma, colon, breast, bladder, prostate carcinoma, or Extramammary Paget disease (EMPD).

13. The method of claim 9, wherein the method further comprises separately, sequentially, or simultaneously administering to the subject one or more immune checkpoint blocking agents selected from anti-PD-L1 antibody, anti-PD-1 antibody, or anti-CTLA-4 antibody.

14. The MVAΔE5RΔE3L virus of claim 1, wherein the knocked out E5R and the knocked out E3L gene comprise replacement of at least a portion of the E5R gene and the E3L gene with one or more gene cassettes comprising one or more heterologous nucleic acid molecules.

15. The MVAΔE5ΔE3L virus of claim 1, wherein the virus further comprises a heterologous nucleic acid molecule encoding hOX40L (MVAΔE3LΔE5R-hOX40L).

16. The MVAΔE5RΔE3L virus of claim 1, wherein the virus further comprises a heterologous nucleic acid molecule encoding hFlt3L, and a heterologous nucleic acid molecule encoding hOX40L (MVAΔE3LΔE5R-hFlt3L-hOX40L).

17. The MVAΔE5RΔE3L virus of claim 16, wherein the virus further comprises one or more heterologous nucleic acid molecules encoding one or more of hIL-2, hIL-15, hIL-15/IL-15Rα, hIL-18, hIL-21, anti-huCTLA-4, anti-huPD-1, anti-huPD-L1, GITRL, 4-1BBL, or CD40L, and/or a knockout of any one or more of thymidine kinase (ΔTK), C7 (ΔC7L), B2R (ΔB2R), WR200, IL18BP, K7R, C12L, B8R, B14R, N1L, C11R, K1L, M1L, N2L, or WR199.

18. The MVAΔE5RΔE3L virus of claim 1, wherein the virus further comprises a heterologous nucleic acid molecule encoding hFlt3L, a heterologous nucleic acid molecule encoding hOX40L, and a knocked out WR199 gene (ΔWR199) (MVAΔE3LΔE5R-hFlt3L-hOX40LΔWR199).

19. A modified vaccinia Ankara (MVA) virus genetically engineered to comprise a knocked out E5R gene (MVAΔE5R) and a knocked out E3L gene (ΔE3L), a heterologous nucleic acid molecule encoding hFlt3L, a heterologous nucleic acid molecule encoding hOX40L, a heterologous nucleic acid molecule encoding hIL-12, and a knocked out WR199 gene (ΔWR199) (MVAΔE3LΔE5R-hFlt3L-hOX40LΔWR199-hIL-12).

20. The MVAΔE3LΔE5R-hFlt3L-hOX40LΔWR199-hIL-12 virus of claim 19, wherein the virus further comprises one or more heterologous nucleic acid molecules encoding one or more of hIL-2, hIL-15, hIL-15/IL-15Rα, hIL-18, hIL-21, anti-huCTLA-4, anti-huPD-1, anti-huPD-L1, GITRL, 4-1BBL, or CD40L, and/or a knockout of any one or more of thymidine kinase (ΔTK), C7 (ΔC7L), B2R (ΔB2R), WR200, IL18BP, K7R, C12L, B8R, B14R, N1L, C11R, K1L, M1L, or N2L.

21. An immunogenic composition comprising the MVAΔE3LΔE5R-hFlt3L-hOX40LΔWR199-hIL-12 virus of claim 19.

22. The immunogenic composition of claim 21, further comprising a pharmaceutically acceptable carrier and/or adjuvant.

23. A nucleic acid sequence encoding the MVAΔE3LΔE5R-hFlt3L-hOX40LΔWR199-hIL-12 virus of claim 19.

24. A kit comprising the MVAΔE3LΔE5R-hFlt3L-hOX40LΔWR199-hIL-12 virus of claim 19 and instructions for use thereof.

* * * * *